US009200299B2

(12) United States Patent
Friedman et al.

(10) Patent No.: US 9,200,299 B2
(45) Date of Patent: Dec. 1, 2015

(54) GENETICALLY ENGINEERED CELL ENCODING OLE AMINO ACID MOTIFS IN A CARBON SOURCE PRODUCING ALIPHATIC KETONES OR OLEFINS

(75) Inventors: Lisa Friedman, So. San Francisco, CA (US); Bernardo da Costa, So. San Francisco, CA (US)

(73) Assignee: REG LIFE SCIENCES, LLC, Ames, IA (US)

( * ) Notice: Subject to any disclaimer, the term of this patent is extended or adjusted under 35 U.S.C. 154(b) by 1388 days.

(21) Appl. No.: 12/278,962

(22) PCT Filed: May 20, 2008

(86) PCT No.: PCT/US2008/064274
§ 371 (c)(1),
(2), (4) Date: Aug. 8, 2008

(87) PCT Pub. No.: WO2008/147781
PCT Pub. Date: Dec. 4, 2008

(65) Prior Publication Data
US 2010/0235934 A1   Sep. 16, 2010

Related U.S. Application Data

(60) Provisional application No. 60/931,370, filed on May 22, 2007, provisional application No. 60/931,939, filed on May 25, 2007, provisional application No. 60/951,944, filed on Jul. 25, 2007, provisional application No. 60/974,810, filed on Sep. 24, 2007.

(51) Int. Cl.
| | |
|---|---|
| *C12N 15/85* | (2006.01) |
| *C12P 7/64* | (2006.01) |
| *C10G 3/00* | (2006.01) |
| *C10L 1/06* | (2006.01) |
| *C10L 1/08* | (2006.01) |
| *C12N 9/02* | (2006.01) |
| *C12N 9/10* | (2006.01) |

(52) U.S. Cl.
CPC . *C12P 7/649* (2013.01); *C10G 3/00* (2013.01); *C10L 1/06* (2013.01); *C10L 1/08* (2013.01); *C12N 9/0004* (2013.01); *C12N 9/1029* (2013.01); *C10G 2300/1014* (2013.01); *C10G 2300/1018* (2013.01); *C10G 2400/02* (2013.01); *C10G 2400/04* (2013.01); *C10G 2400/08* (2013.01); *C10G 2400/22* (2013.01); *Y02E 50/13* (2013.01)

(58) Field of Classification Search
CPC .......................... C10G 3/00; C10G 2300/1088
See application file for complete search history.

(56) References Cited

U.S. PATENT DOCUMENTS

| | | |
|---|---|---|
| 2003/0233675 A1 | 12/2003 | Cao et al. |
| 2005/0130126 A1 | 6/2005 | Dumaz et al. |
| 2006/0014977 A1 | 1/2006 | Miller et al. |
| 2006/0206963 A1 | 9/2006 | Voelker et al. |
| 2007/0270319 A1 | 11/2007 | Seggelkow et al. |
| 2010/0242345 A1 | 9/2010 | Keasling et al. |
| 2010/0251601 A1 | 10/2010 | Hu et al. |

FOREIGN PATENT DOCUMENTS

| | | |
|---|---|---|
| WO | WO 2007/136762 A2 | 11/2007 |
| WO | WO 2008/119082 A2 | 10/2008 |

OTHER PUBLICATIONS

Rude et al (Applied and Environmental Microbiology, Mar. 2011, p. 1718-1727 vol. 77, No. 5).*
Allen, E.E. et al., "Structure and regulation of the omega-3 polyunsaturated fatty acid synthase genes from the deep-sea bacterium *Photobacterium profundum* strain SS9", Microbiology, vol. 148(6): 1903-1913 (2002).
Crossman, L.C. et al., "The complete genome, comparative and functional analysis of *Stenotrophomonas maltophilia* reveals an organism heavily shielded by drug resistance determinants", Genome Biology, vol. 9(4): R74.1-R74.13 (2008).
da Silva, A.C.R. et al., "Comparison of the genomes of two *Xanthomonas* pathogens with differing host specificities", Nature, vol. 417(6887): 459-463 (2002).
Database UniProt [Online], "Subname: Full=3-oxoacyl-(Acyl-carrier protein) synthase", Database accession No. A0H249 (2006).
Database UniProt [Online], "Subname: Full=Strain CBS138 chromosome G complete sequence", Database accession No. Q6FTDO (2004).
Database UniProt [Online], "Subname: Full=3-oxoacyl-[ACP] synthase III", Database accession No. Q8PQT8 (2002).
Kalscheuer, R. et al., "Microdiesel:*Escherichia coli* engineered for fuel production", Microbiology, vol. 152(9): 2529-2536 (2006).
International Search Report and Written Opinion from PCT/US2008/064274, mailed Feb. 20, 2009.

(Continued)

*Primary Examiner* — Deborah Crouch
*Assistant Examiner* — Magdalene Sgagias
(74) *Attorney, Agent, or Firm* — Foley & Lardner LLP

(57) ABSTRACT

The invention provides isolated nucleic acids and isolated polypeptides involved in the synthesis of hydrocarbons and hydrocarbon intermediates. Homologs of, conservative variants of, and sequences having at least about 35% sequence identity with nucleic acids involved in the synthesis of hydrocarbons and hydrocarbon intermediates are also provided. The invention further provides methods for producing an aliphatic ketone or a hydrocarbon, as well as a method for identifying an enzyme useful for the production of hydrocarbons.

28 Claims, 76 Drawing Sheets

(56) References Cited

OTHER PUBLICATIONS

Birge, et al., "Acyl Carrier Protein. XVI.Intermediate Reactions of Unsaturated Fatty Acid Synthesis in *Escerichia Coli* and Studies of fab B Mutants", *J.Biol.Chem.* 247(16): 4921-4929 (1972).
Broun et al., "A bifunctional oleate 12-hydroxylase: Desaturase from *Lesquerella fendlerr*", Plant Journal 13(2): 201-210 (1998).
Brown et al., "Probing the Mechanism of the *Mycobacterium tuberculosis*-Ketoacyl-Acyl Carrier Protein Synthase III mtFabH. Factors Influencing Catalysis and Substrate Specificity" *J.Biol.Chem.* 280(37): 32539-32547 (2005).
Cropp et al., "Fatty-acid biosynthesis in a branched-chain α-keto acid dehydrogenase mutant of Streptomycesavermitilis".
da Silva et al., "Comparison of the Genomes of Two *Xanthomonas* Pathogens with Differing Host Specificities" *Nature* 417: 459-463 (2002).
Henry et al., "*Escherichia coli* Transcription Factor That Both Activates Fatty Acid Synthesis and Represses Fatty Acid Degradation", *J. Mol. BioE.* 222: 843-849 (1991).
Hoang et al., "A broad-host-range Flp-*FRT* recombination system for site-specific excision of chromosomally-located DNA sequences: application for isolation of unmarked *Pseudomonas aeruginosa* mutants", *Gene* 212: 77-86 (1998).
Horton et al., "Engineering hybrid genes without the use of restriction enzymes: gene splicing by overlap extension", *Gene* 77: 61-68 (1989).
Keasling et al., "Metabolic engineering delivers next-generation biofuels", *Nature Biotechnology* 26(3):298-299 (2008).
Mayer et al., "Identification of amino acid residues involved in substrate specificity of plant acyl-ACP thioesterases using a bioinformatics-guided approach" *BMC Plant Biology* 7(1) (2007).
Mohan et al, "An *Escherichia coli* Gene (*FabZ*) Encoding (3*R*)-Hydroxymyristoyl Acyl Carrier Protein Dehydrase. Relation to fubA and Suppression of Mutations in Lipid A Biosynthesis", *J.Biol.Chem* 269(52): 32896-32903 (1994).
Morgan-Kiss et al, "The *Escherichia coli* fadK (ydiD) Gene Encodes an Anerobically Regulated Short Chain Acyl-CoA Synthetase," *J. Biol. Chem.*, 279(36): 37324-37333 (2004).
Morgan-Kiss et al., "The *Lactococcus lactis* FabF Fatty Acid Synthetic Enzyme can Functionally Replace both the FabB and FabF Proteins of *Escherichia coli* and the FabH Protein of *Lactococcus lactis*," *Arch. Microbial.* 190: 427-437 (2008).
Naccarato et al., "In Vivo and In Vitro Biosynthesis of Free Fatty Alcohols in *Escherichia coli* K-12," *Lipids*, 9(6): 419-428 (1973).
NCBI Reference Sequence GI:49532534, Putative Alcohol Dehydrogenase [*Acinetobacter* sp. ADP1](2004).
Nunn et al., "Transport of long-chain fatty acids by *Escherichia coil*: Mapping and characterization of mutants in the fadL gene" *PNAS* 75(7): 3377-3381 (1978).
Nunn et al., "Role for fadR in Unsaturated Fatty Acid Biosynthesis in *Escherichia coli*", *J.Bacteriol.* 154(2):554-560 (1983).
Perez et al., "*Escherichia coli* YqhD Exhibits Aldehyde Reductase Activity and Protects from the Harmful Effect of Lipid Peroxidation-derived Aldehydes" *J.Biol.Chem.* 283(12): 7346-7353 (2008).
Philips et al., "*Kineococcus radiotolerans* sp. nov., a radiation-resistant, Gram-positive bacterium", *Int. J. Syst. Evol. Microbiol.* 52: 933-938 (2002).
Rafi et al., "Structure of Acyl Carrier Protein Bound to FabI, the FASII Enoyl Reductase from *Escherichia Coil*" *J.Biol.Chem.* 281(51): 39285-39293 (2006).
Rawlings et al., "The Gene Encoding *Escherichia coil* Acyl Carrier Protein Lies within a Cluster of Fatty Acid Biosynthetic Genes", *J.Biol.Chem.* 267(9):5751-5754 (1992).
Rawlings et al., "Biosynthesis of fatty acids and related metabolites", *Natural Product Reports* 15: 275-308 (1998).
Ray et al., "Activation of long chain fatty acids with acyl carrier protein: Demonstration of a new enzyme, acyl-acyl carrier protein synthetase, in *Escherichia coil*" *PNAS* 73(12):4374-4378 (1976).
Ren et al., "FabG, an NADPH-Dependent 3-Ketoacyl Reductase of *Pseudomonas aeruginosa*, Provides Precursors for Medium-Chain-Length Poly-3-Hydroxyalkanoate Biosynthesis in *Escherichia coil*", *J. Bacteriol.*182(10):2978-2981 (2000).
Rock et al., "Acyl-Acyl Carrier Protein Synthetase from *Escherichia coli*", *Meth.Enzymol.* 71: 163-168 (1981).
Rose et al., "Molecular cloning of the gene for the yeast homolog (ACB) of diazepam binding inhibitor/endozepine/acyl-CoA-binding protein", *PNAS* 89: 11287-11291 (1992).
Rude et al., "Terminal Olefin (1-Alkene) Biosynthesis by a Novel P450 Fatty Acid Decarboxylase from *Jeotgalicoccus* Species", *Appl. Environ.Microbiol.* 77(5): 1718-1727 (2011).
Rude et al., "New microbial fuels: a biotech perspective", *Current Opinion in Microbiology* 12: 274-281 (2009).
Schweizer et al., "Microbial Type I Fatty Acid Synthases (FAS): Major Players in a Network of Cellular FAS Systems", *Microbiol. Mol.Biol.Rev.* 68(3): 501-517 (2004).
Ta et al., "Cloning, Sequencing, and Overexpression oaf [2Fe-2S] Ferredoxin Gene from *Escherichia coil*", *J.Biol.Chem.* 267(16):11120-11125 (1992).
Tornabene et al., "*Pseudomonas maltophilia*: identification of the hydrocarbons, glycerides, and glycolipoproteins of cellular lipids" *Can.J.Microbiol.* 24: 525-532 (1978).
Vadali et al., "Cofactor engineering of intracellular CoA/acetyl-CoA and its effect on metabolic flux redistribution in *Escherichia coli*" *Metabolic Engineering* 6: 133-139 (2004).
Van Den Berg et al., "The FadL family: unusual transporters for unusual substrates", *Curr. Opin. Struct. Biol.* 15: 401-407 (2005).
Vanderhoeven et al., "Biosynthesis and Elongation of Short- and Medium-Chain-Length Fatty Acids", *Plant Physiology* 122: 275-282 (2000).
Voelker et al. "Alteration of the Specificity and Regulation of Fatty Acid Synthesis of *Escherichia coli* by Expression of a Plant Medium-Chain Acyl-Acyl Carrier Protein Thioesterase," *J. Bacteriol.*, 176(23): 7320-7327 (1994).
Wang et al., "Functional Replacement of the FabA and FabB Proteins of *Escherichia coli* Fatty Acid Synthesis by *Enterococcus faecalis* FabZ and FabF Homologues", *J.Biol.Chem.*279(33): 34489-34495 (2004).
White et al., "Carboxylic acid reductase: a new tungsten enzyme catalyzes the reduction of non-activated carboxylic acids to aldehydes", *Eur. J. Biochem.* 184: 89-96 (1989).
Xu et al. "The FadRzDNA Complex. Transcriptional Control of Fatty Acid Metabolism in *Escherichia Coli*", *J.Biol.Chem.* 276(20): 17373-17379, 2001.
Yoo et al., "Determination of the native form of FadD, the *Escherichia coli* fatty acyl-CoA synthetase, and characterization of limited proteolysis by outer membrane protease OmpT", *Biochem. J.* 360: 699-706 (2001).
Zhang, et al. "The FabR (YijC) Transcription Factor Regulates Unsaturated Fatty Acid Biosynthesis in *Escherichia coil*," *J. Biol. Chem.*, 277(18): 15558-15565 (2002).
Zhang et al., "Inhibiting Bacterial Fatty Acid Synthesis", *J.Biol. Chem.* 281(26): 17541-17544 (2006).
Zhang et al, "Structural Basis for Catalytic and Inhibitory Mechanisms of β-Hydroxyacyl-acyl Carrier Protein Dehydratase (FabZ)", *J.Biol.Chem.* 283(9):5370-5379 (2008).
Zhang, et al. "Molecular effect of FadD on the regulation and metabolism of fatty acid in *Escherichia coli*," *FEMS Microbiol. Lett.*, 259(2): 249-253 (2006).
Zhu et al., "Functions of the *Clostridium acetobutylicium* FabF and FabZ proteins in unsaturated fatty acid biosynthesis", *BMC Microbiology* 9:119 (2009).
Zimhony et al., "Characterization of *Mycobacterium smegmatis* Expressing the *Mycobacterium tuberculosis* Fatty Acid Synthase I (fas1) Gene", *J.Bacteriol.* 186(13): 4051-4055 (2004).

\* cited by examiner

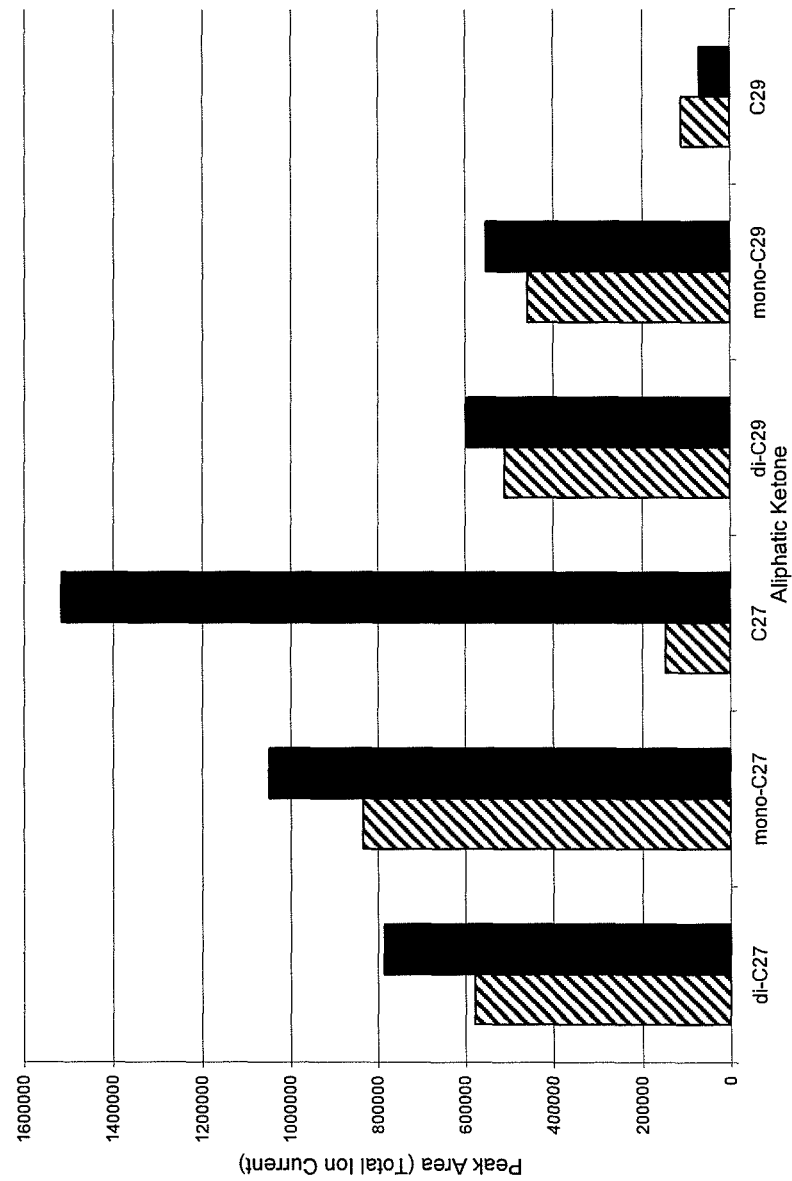

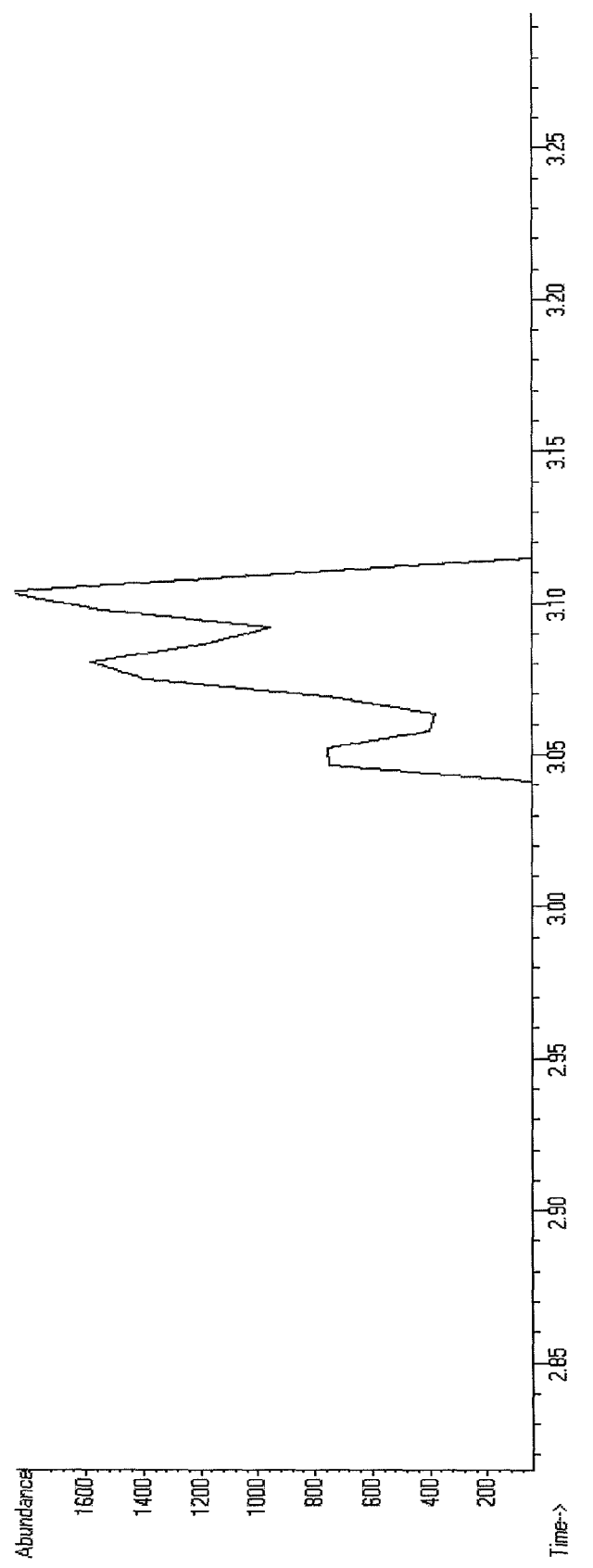

GENETICALLY ENGINEERED CELL ENCODING OLE AMINO ACID MOTIFS IN A CARBON SOURCE PRODUCING ALIPHATIC KETONES OR OLEFINS

CROSS-REFERENCE TO RELATED APPLICATIONS

This patent application claims the benefit of U.S. Provisional Patent Application No. 60/931,370, filed May 22, 2007, U.S. Provisional Patent Application No. 60/931,939, filed May 25, 2007, U.S. Provisional Patent Application No. 60/951,944, filed Jul. 25, 2007, and U.S. Provisional Patent Application No. 60/974,810, filed Sep. 24, 2007, which are incorporated by reference.

INCORPORATION-BY-REFERENCE OF MATERIAL SUBMITTED ELECTRONICALLY

Incorporated by reference in its entirety herein is a computer-readable nucleotide/amino acid sequence listing submitted concurrently herewith and identified as follows: One 1,359,129 Byte ASCII (Text) file named "SequenceListingLS8US.TXT," created on May 3, 2010.

BACKGROUND OF THE INVENTION

Developments in technology have been accompanied by an increased reliance on fuel sources, and such fuel sources are becoming increasingly limited and difficult to acquire. With the burning of fossil fuels taking place at an unprecedented rate, it is likely that the world's fuel demand will soon outweigh the current fuel supplies.

The majority of fuel sources currently produced are from petroleum sources or from the chemical processing of vegetable oils. Petroleum sources face a number of problems: they are non-renewable resources, they require an extensive period of time (years) to form, and formation is restricted to distinct locations. As petroleum is consumed as a source of energy, geological petroleum resources eventually will be depleted.

As a result, efforts have been directed toward harnessing sources of renewable energy, such as sunlight, water, wind, and biomass. The use of biomasses to produce new sources of fuel which are not derived from petroleum sources (i.e., biofuel) has emerged as one alternative option. Biofuel (e.g., biodiesel) is a biodegradable combustible fuel made of long chain alkanes and esters. Biodiesel can be used in most internal combustion diesel engines in either a pure form, which is referred to as "neat" biodiesel, or as a mixture in any concentration with regular petroleum diesel.

In theory, biofuel can be produced from any biological carbon source. The most common biological carbon source, by far, is photosynthetic plants that capture solar energy. Many different plants and plant-derived materials are used to manufacture biofuels. One of the greatest technical challenges is to develop ways to convert biomass energy specifically to liquid fuels for transportation. A commonly used strategy to produce biofuel is to grow sugar crops (e.g., sugar cane or sugar beet) or starch crops (e.g., corn or maize) and then use yeast fermentation to produce ethanol (i.e., ethyl alcohol). Another commonly used strategy to produce biofuel is to grow plants that naturally produce oils, such as oil palm, soybean, or jatropha. An alternative source of naturally produced oil is from organisms, such as algae. When these oils are heated, their viscosity is reduced, and they can be burned directly in a diesel engine. Alternatively, the oils can be chemically processed to produce fuels, such as biodiesel. Current methods of making biodiesel involve transesterification of triacylglycerides (e.g., vegetable oil or animal fat) which leads to a mixture of fatty esters and the unwanted side product glycerin. This results in a product that is heterogeneous and a waste product that leads to economic inefficiencies.

Vegetable oils remain an attractive alternative to fossil fuels because they are renewable resources. However, vegetable oils are an important part of the food chain. It is unlikely that sufficient crops can be grown to meet the needs for both food and industrial chemicals, such as fuels and polymers. In addition, oil-producing plants can be restricted by the environmental conditions in which they flourish. Furthermore, vegetable oils are not hydrocarbons (e.g., alkanes or alkenes). Rather, vegetable oils are primarily triglycerides, which contain oxygen molecules, that when burned in a combustion engine will coke up the engine.

In view of the foregoing, it would be desirable to enable the production of fuels from alternative sources in order to provide an improved method of producing biofuels. The invention provides nucleic acid sequences that encode polypeptides that are involved in the biosynthesis of hydrocarbons and hydrocarbon intermediates. In addition, the invention provides methods of using the same for the production of biofuels. The invention described herein overcomes the problems associated with limited, non-renewable hydrocarbon resources and provides improved methods that can be used to produce biofuels. These and other advantages of the invention will become apparent from the detailed description provided herein.

BRIEF SUMMARY OF THE INVENTION

The invention provides an isolated nucleic acid encoding a polypeptide comprising an OleA, OleB, OleC, or OleD amino acid motif sequence.

The invention provides an isolated nucleic acid encoding a polypeptide comprising an amino acid sequence selected from the group consisting of (a) an OleA, OleB, OleC, OleD, or OleBC amino acid sequence; (b) a homolog of an OleA, OleB, OleC, OleD, or OleBC amino acid sequence; (c) a conservative variant of an OleA, OleB, OleC, OleD, or OleBC amino acid sequence comprising one or more conserved amino acid substitutions; and (d) an amino acid sequence having at least about 35% sequence identity with an OleA, OleB, OleC, OleD, or OleBC amino acid sequence.

The invention provides a method for producing an aliphatic ketone comprising incubating a substrate with OleA, under conditions sufficient for producing an aliphatic ketone. The invention also provides a method for producing a hydrocarbon comprising incubating a substrate with OleA, OleB, OleC, OleBC, OleD, or a combination thereof under conditions sufficient for producing a hydrocarbon.

The invention provides an isolated polypeptide comprising an amino acid sequence encoding OleA, wherein the amino acid sequence comprises one or more amino acid substitutions, additions, insertions, or deletions.

The invention provides an isolated polypeptide comprising an amino acid sequence encoding OleC, wherein the amino acid sequence comprises one or more amino acid substitutions, additions, insertions, or deletions.

The invention provides an isolated polypeptide comprising an amino acid sequence encoding OleD, wherein the amino acid sequence comprises one or more amino acid substitutions, additions, insertions, or deletions.

The invention provides an isolated nucleic acid encoding a polypeptide having the same biological activity as a polypeptide comprising the amino acid sequence encoding OleA, OleC, or OleD.

The invention further provides a genetically engineered organism comprising an exogenous nucleic acid sequence stably incorporated into the genome of an organism upstream of a genomic nucleic acid sequence that (a) has at least about 35% sequence identity to a nucleic acid sequence encoding OleA, OleB, OleC, or OleD and (b) encodes a polypeptide.

The invention provides a genetically engineered organism prepared by (a) providing an organism having a nucleic acid sequence having at least about 35% sequence identity to OleC or OleD and (b) deleting or mutating the nucleic acid sequence.

The invention also provides a method for identifying an enzyme useful for the production of hydrocarbons comprising transforming a cell comprising polypeptides selected from the group consisting of (a) OleA and OleD, (b) OleA and OleC, and (c) OleC and OleD with a nucleic acid encoding an enzyme suspected of having the ability to produce hydrocarbons; and determining whether the cell produces hydrocarbons, wherein the existence of hydrocarbon production by the cell indicates that the nucleic acid encodes a polypeptide useful for the production of hydrocarbons.

The invention provides for a hydrocarbon having a $\delta^{13}C$ of about −28 or greater. The invention also provides for a hydrocarbon having a pMC of at least about 50.

BRIEF DESCRIPTION OF THE SEVERAL VIEWS OF THE DRAWING(S)

FIG. 1 is a total ion chromatogram of hydrocarbons extracted from *E. coli* C41(DE3) ΔfadE producing proteins OleA (SEQ ID NO: 2), OleC (SEQ ID NO: 6), and OleD (SEQ ID NO: 8).

FIGS. 2A-2J are a series of ten MS spectra for the hydrocarbons shown in FIG. 1. FIG. 2A shows the MS spectra data for C27 triene. FIG. 2B shows the MS spectra data for C27 diene. FIG. 2C shows the MS spectra data for C27 monoene. FIG. 2D shows the MS spectra data for C28 diene. FIG. 2E shows the MS spectra data for C29 triene. FIG. 2F shows the MS spectra data for C29 diene. FIG. 2G shows the MS spectra data for C29 monoene. FIG. 2H shows the MS spectra data for C30 diene. FIG. 2I shows the MS spectra data for C31 triene. FIG. 2J shows the MS spectra data for C31 diene.

FIG. 3 is a total ion chromatogram of hydrocarbons extracted from *S. maltophilia*.

FIGS. 4A-4E are a series of total ion chromatograms from methanol:hexane extractions of various *Stenotrophomonas maltophilia* cultures. FIG. 4A shows olefins detected in the extract from wild type *S. maltophilia* ATCC 17679. FIG. 4B shows that no major peaks were detected in the extract from *S. maltophilia* ΔoleA strain (deletion of oleA). FIG. 4C shows olefins detected in the extract from wild type *S. maltophilia* ATCC 17679. FIG. 4D shows aliphatic ketones detected in the extracts from *S. maltophilia* ΔoleC (deletion of oleC). FIG. 4E shows the aliphatic ketones detected in the extracts from *S. maltophilia* ΔoleD (deletion of oleD).

FIGS. 5A-5C are a series of total ion chromatograms of aliphatic ketones extracted from *E. coli* C41(DE3) producing protein OleA (SEQ ID NO: 2). FIG. 5A shows aliphatic ketones extracted from *E. coli* C41(DE3) producing protein OleA (SEQ ID NO: 2). FIG. 5B shows the extract of FIG. 5A overlayed with 16-hentriacontone (saturated C31 ketone) FIG. 5C shows the extract of FIG. 5A overlayed with 14-heptacosanone (saturated C27 ketone).

FIGS. 6A-6H are a series of MS spectra for each aliphatic ketone shown in FIG. 5A. FIG. 6A shows a C27:2 ketone (with two unsaturated bonds). FIG. 6B shows a C27:1 ketone (with one double bond). FIG. 6C shows a C27 ketone (saturated). FIG. 6D shows a C29:2 ketone (with two unsaturated bonds). FIG. 6E shows a C29:1 ketone (with one double bond). FIG. 6F shows a C29 ketone (saturated). FIG. 6G shows a C31:2 ketone (with two unsaturated bonds). FIG. 6H shows C31:1 ketone (with one double bond).

FIGS. 7A-7C demonstrate that aliphatic ketones are detected in an in vitro assay combining lysate from *E. coli* cells expressing oleA (SEQ ID NO: 1) with acyl-CoA substrates. FIG. 7A is a total ion chromatogram from an extract of a sample containing OleA-lysate with a myristoyl-CoA substrate. FIG. 7B is a total ion chromatogram from the control extract containing OleA-lysate with no added myristoyl-CoA substrate. FIG. 7C is a graph comparing the amount of ketone found in each of the samples. The y-axis represents the area under the curve and the x-axis represents the indicated aliphatic ketones. The hatched bars represent the sample with OleA-cell extract only and the black bars represent OleA-cell extract combined with myristoyl-CoA substrate.

FIGS. 8A and 8B depict GC/MS data of the extracts from an in vitro assay containing purified OleA protein, myristoyl-CoA substrate, and *E. coli* C41(DE3)-cell lysate. FIG. 8A is a total ion chromatogram that shows a peak eluting at the retention time of 13.95 minutes on the total ion chromatogram, indicating the presence of saturated C27 aliphatic ketone. FIG. 8B depicts the MS spectra for the C27 aliphatic ketone.

FIG. 9 is a graph of the area under the GC curve for aliphatic ketones that were detected in extracts from fermentations of *E. coli* C41(DE3) ΔfadE containing various vectors for the expression of oleA protein sequences. The black bars represent the amount of aliphatic ketone observed in extracts from a strain expressing a plasmid containing oleA based on the genome of *Chloroflexus aggregans*, the diagonal bars represent the amount of aliphatic ketone observed in extracts from a strain expressing a plasmid containing oleA based on the genome of *Xanthomonas axonopodis*, the white bars represent the amount of aliphatic ketone observed in extracts from a strain expressing a plasmid containing the native nucleotide sequence encoding the OleA polypeptide from *Stenotrophomonas maltophilia* ATCC17679, and the hatched bars represent the amount of aliphatic ketone observed in extracts from a strain expressing a plasmid containing a synthetic, codon optimized nucleotide sequence encoding the OleA polypeptide from *Stenotrophomonas maltophilia* R551-3 (*S. maltophilia* CO). *S. maltophilia* CO refers to the expression of a codon optimized synthetic DNA which encodes the amino acid sequence of OleA from *S. maltophilia* R551-3 (SEQ ID NO: 4).

FIG. 10 is a graph that shows the increase in aliphatic ketones production that resulted due to the expression of oleA in the *E. coli* C41(DE3) strains with alterations in fadE, fadD, and/or tesA. The white bars represent C27 ketone, the hatched bars represent C29 ketone, and the black bars represent C31 ketone. A (−) sign indicates a knock out of the gene activity and a (+) sign indicates overexpression of the gene of interest.

FIG. 11 is a graph that shows the increase in olefin production that resulted due to the expression of oleA, oleC, and oleD in the *E. coli* C41(DE3) strains with alterations in fadE, fadD, and/or tesA. The white bars represent C27 olefin, the hatched bars represent C29 olefin, and the black bars represent C31 olefin. A (−) sign indicates a knock out of the gene activity and a (+) sign indicates overexpression of the gene of interest.

FIGS. 12A-12E are graphs that show the observation of tetradecanal, 14-heptacosanone, and isomers of heptacosene by GC/MS chromatography of the organic extract of the in vitro reactions with OleA and OleD enzymes combined with myristoyl coenzyme A. FIG. 12A is a total ion chromatogram of tetradecanal. FIG. 12B is a total ion chromatogram with 2 peaks denoting isomers of heptacosene. FIG. 12C is an MS spectrum of peak 1 from FIG. 12B. FIG. 12D is an MS spectrum of peak 2 from FIG. 12B. FIG. 12E is a total ion chromatogram of 14-heptacosanone.

FIGS. 13A-13C are a series of total ion chromatograms that depict the observation of tetradecanal, 14-heptacosanone, and isomers of heptacosene by GC/MS chromatography of the organic extract of two in vitro reactions of Ole enzymes combined with myristoyl coenzyme A. One reaction comprised OleA and OleD enzymes, and the other comprised OleA, OleD, and OleB enzymes. FIG. 13A is a total ion chromatogram of tetradecanal. FIG. 13B is a total ion chromatogram of 2 peaks denoting isomers of heptacosene. FIG. 13C is a total ion chromatogram of 14-heptacosanone. Arrows denote the reaction OleA+OleD+OleB and the reaction of OleA+OleD. The presence of OleB enhances the formation of tetradecanal and heptacosene and decreases the levels of 14-heptacosanone.

FIG. 14 is a total ion chromatogram that demonstrates that the yeast S. cerevisiae can produce functional OleA. FIG. 14 shows a total ion chromatogram of the extract of a reaction of cell lysate from S. cerevisiae pESC-HIS-OleA with the addition of myristoyl coenzyme A. Myristic acid, 14-heptacosanone, and the hexacosane control spike are observed.

FIGS. 15A-15H are a series of total ion chromatograms and MS spectra that demonstrate that deuterated aldehydes and olefins are observed in the organic extract of an in vitro assay containing purified OleA, cell lysate containing OleD, and deuterated NADPH. FIG. 15A is a total ion chromatogram of tetradecanal observed after the extraction of an in vitro reaction comprising OleA, cell lysate containing OleD, myristoyl coenzyme A, and R-(4-$^2$H)NADPH. FIG. 15B is an MS spectrum of the tetradecanal from FIG. 15A. FIG. 15C is a total ion chromatogram of tetradecanal observed after the extraction of an in vitro reaction comprising OleA, cell lysate containing OleD, myristoyl coenzyme A, and S-(4-2H) NADPH. FIG. 15D is an MS spectrum of the tetradecanal from FIG. 15C. FIG. 15E is a total ion chromatogram of isomers of heptacosene formed by the reaction of OleA and cell lysate containing OleD with R-(4-$^2$H)NADPH. FIG. 15F is an MS spectrum of the isomer of heptacosene from FIG. 15E. FIG. 15G is a total ion chromatogram of isomers of heptacosene observed after the extraction of an in vitro reaction comprising OleA, cell lysate containing OleD, myristoyl coenzyme A, and S-(4-$^2$H)NADPH. FIG. 15H is an MS spectrum of the heptacosene from FIG. 15G.

FIGS. 16A-16C are a series of total ion chromatograms that demonstrate the ability to synthesize aliphatic olefins in vitro. FIG. 16A is a total ion chromatogram of the extract from a reaction performed with a cell lysate prepared from E. coli C41(DE3)ΔfadE strain with plasmids for the expression of oleA, oleB, oleC, and oleD with myristoyl coenzyme A. The arrows indicate C27:1, C27:2, and C27:3 heptacosenes. FIG. 16B is a total ion chromatogram of the extract from a reaction performed with a cell lysate prepared from E. coli C41(DE3)ΔfadE strain with plasmids for the expression of oleB, oleC, and oleD with the addition of myristoyl coenzyme A. The arrows indicate C27:1, C27:2, and C27:3 heptacosenes. FIG. 16C is a total ion chromatogram of the extract from a reaction performed with a cell lysate prepared from E. coli C41(DE3)ΔfadE strain with plasmids for the expression of oleA, oleB, oleC, and oleD with the addition of myristoyl-ACP. The arrows indicate C27:1, C27:2, and C27:3 heptacosenes.

FIG. 17A-17J are a series of total ion chromatograms and MS spectra of selected ions for hydrocarbons extracted from fermentations of B. megaterium WH320; pWH1520_OleCDAB. FIG. 17A is a total ion chromatogram of the 25 carbon olefin having a parental ion of 350. FIG. 17B is a mass spectrum of the compounds that elute at retention time 3.092 minutes and is characteristic of a branched C25 monounsaturated olefin. FIG. 17C is a total ion chromatogram of the 26 carbon olefin having a parental ion of 364. FIG. 17D is the mass spectrum of the compounds that elute at retention time 3.390 minutes and is characteristic of a branched C26 monounsaturated olefin. FIG. 17E is a total ion chromatogram of the 27 carbon olefin having a parental ion of 378. FIG. 17F is a mass spectrum of the compounds that elute at retention time 3.567 minutes and is characteristic of a branched C27 monounsaturated olefin. FIG. 17G is a total ion chromatogram of the 28 carbon olefin having a parental ion of 392. FIG. 17H is a mass spectrum of compounds that elute at retention time 3.893 minutes and is characteristic of a branched C28 monounsaturated olefin. FIG. 17I is a total ion chromatogram of the 29 carbon olefin having a parental ion of 406. FIG. 17J is a mass spectrum of compounds that elute at retention time 4.013 minutes and is characteristic of a branched C29 monounsaturated olefin.

FIGS. 18A-18E are a series of total ion chromatograms and MS spectra of extracts from B. subtilis. FIG. 18A is a total ion chromatogram of aliphatic ketones extracted from B. subtilis IHA01; pHT01_OleA. FIG. 18B is a total ion chromatogram of the extract from B. subtilis IHA01; pHT01 that does not produce any aliphatic hydrocarbons. FIG. 18C is a mass spectrum of compounds that elute at retention time 3.584 and is characteristic of branched aliphatic C25 ketones. FIG. 18D is a mass spectrum of compounds that elute at retention time 4.036 and is characteristic of branched aliphatic C27 ketones. FIG. 18E is a mass spectrum of compounds that elute at retention time 4.485 and is characteristic of branched aliphatic C29 ketones.

FIGS. 19A-19B is a total ion chromatogram and mass spectra of extracts from Arthrobacter aurescens TC1. FIG. 19A is a total ion chromatogram of hydrocarbons extracted from Arthrobacter aurescens TC1. The three peaks indicate various branched versions of monounsaturated C29 olefin. FIG. 19B is a mass spectrum of compounds that elute at retention time 13.6 minutes and is characteristic of monounsaturated C29 olefin.

DETAILED DESCRIPTION OF THE INVENTION

Figure 1:
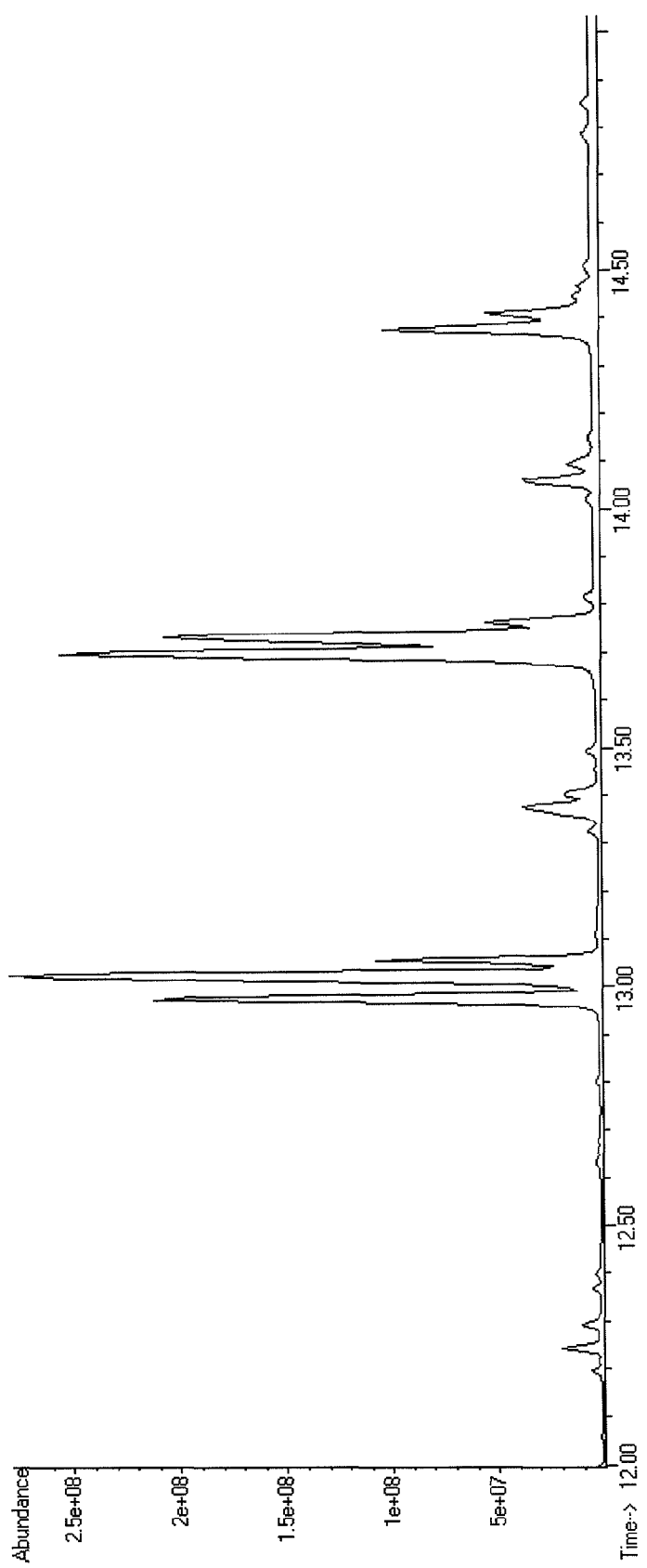
Figure 2A:
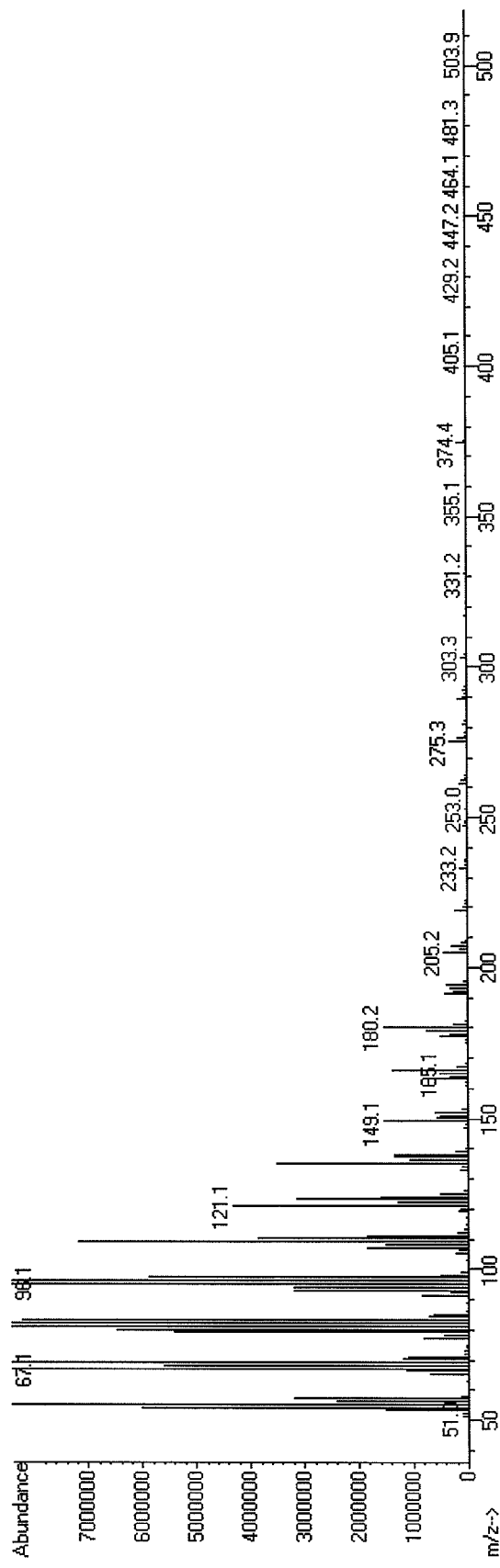
Figure 2B:
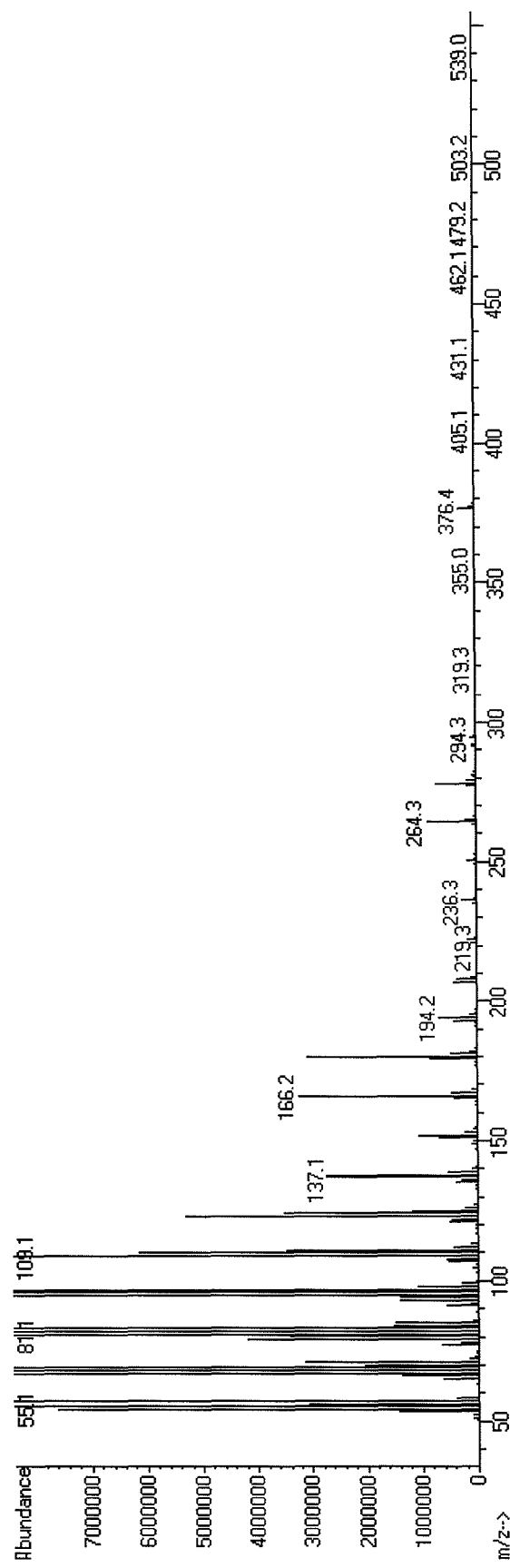
Figure 2C:
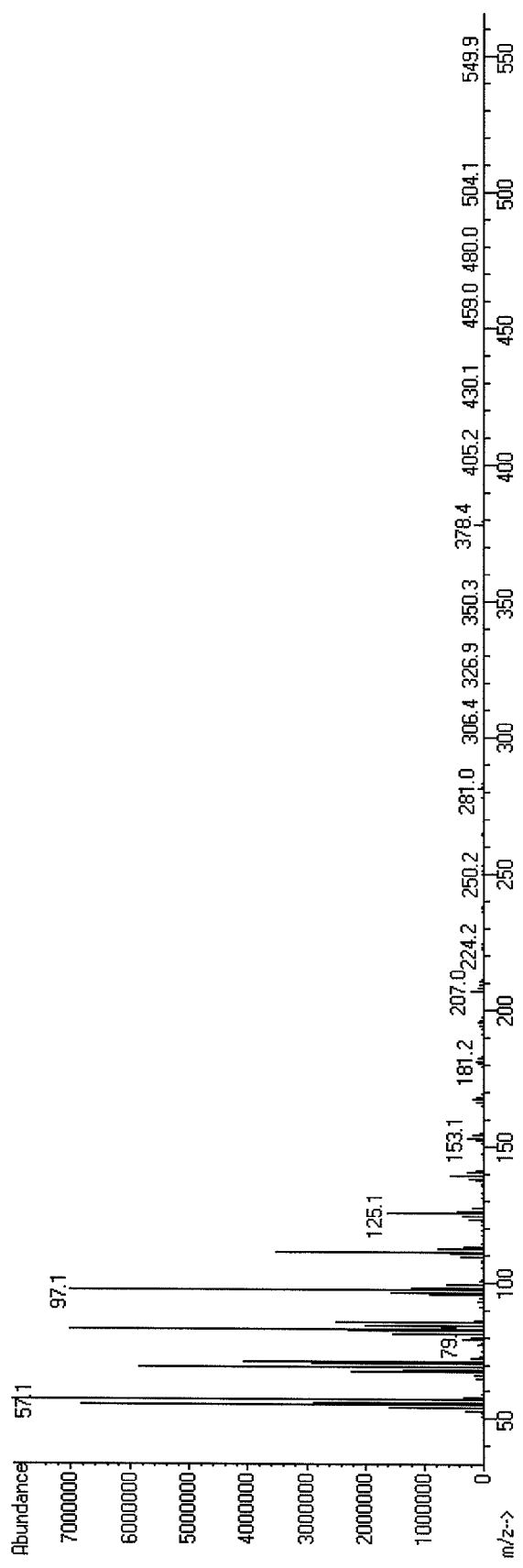
Figure 2D:
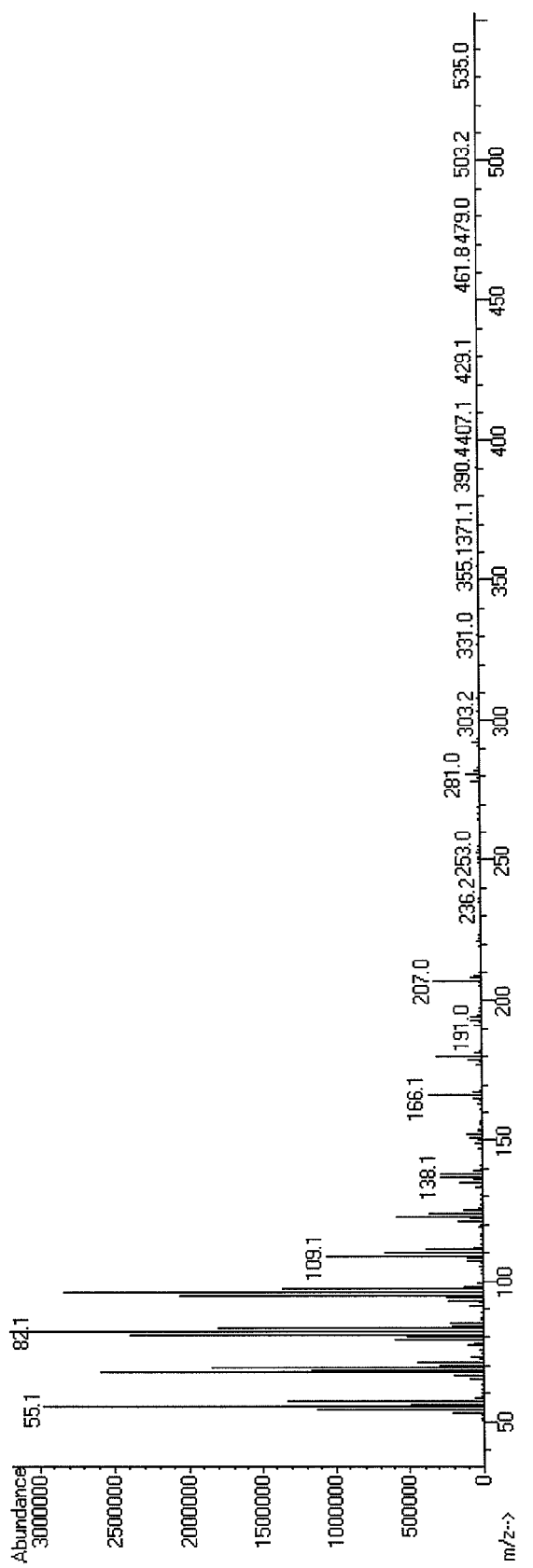
Figure 2E:
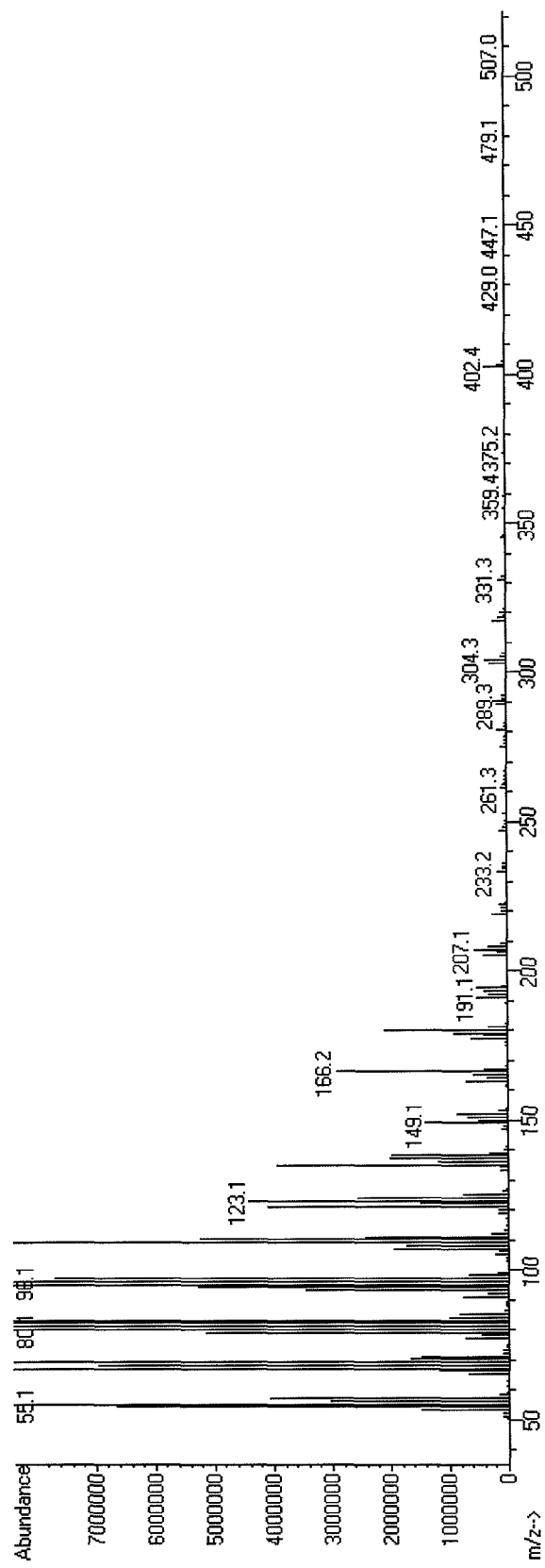
Figure 2F:
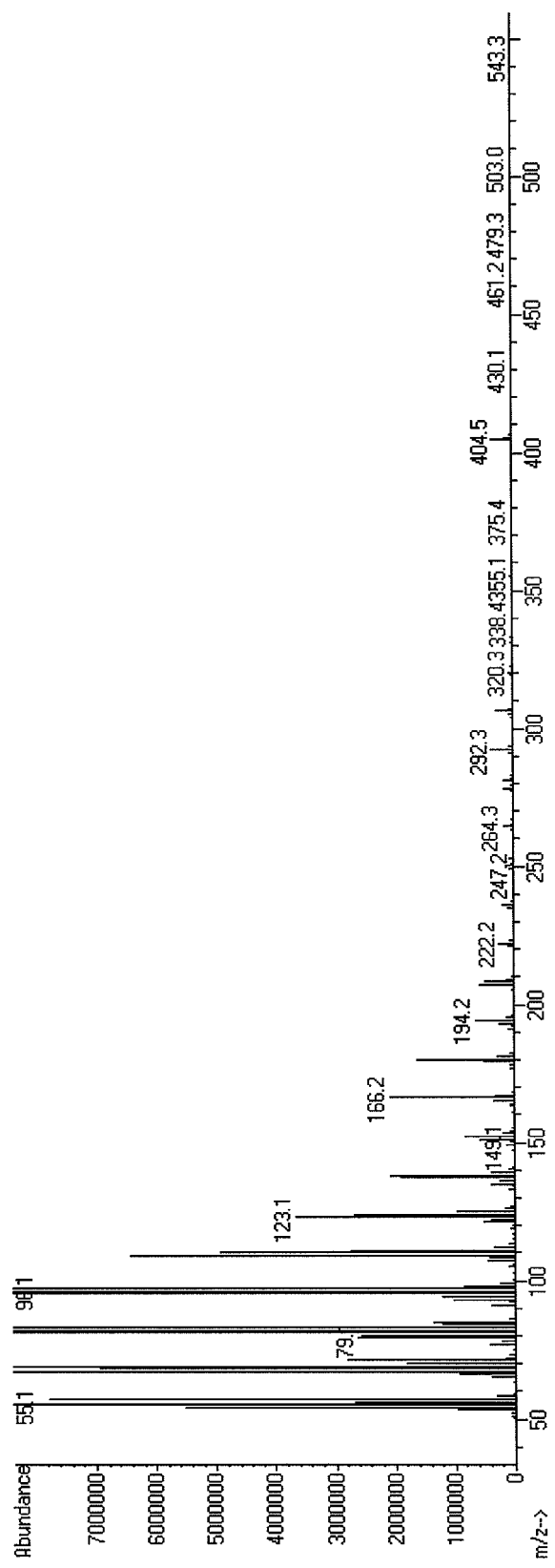
Figure 2G:
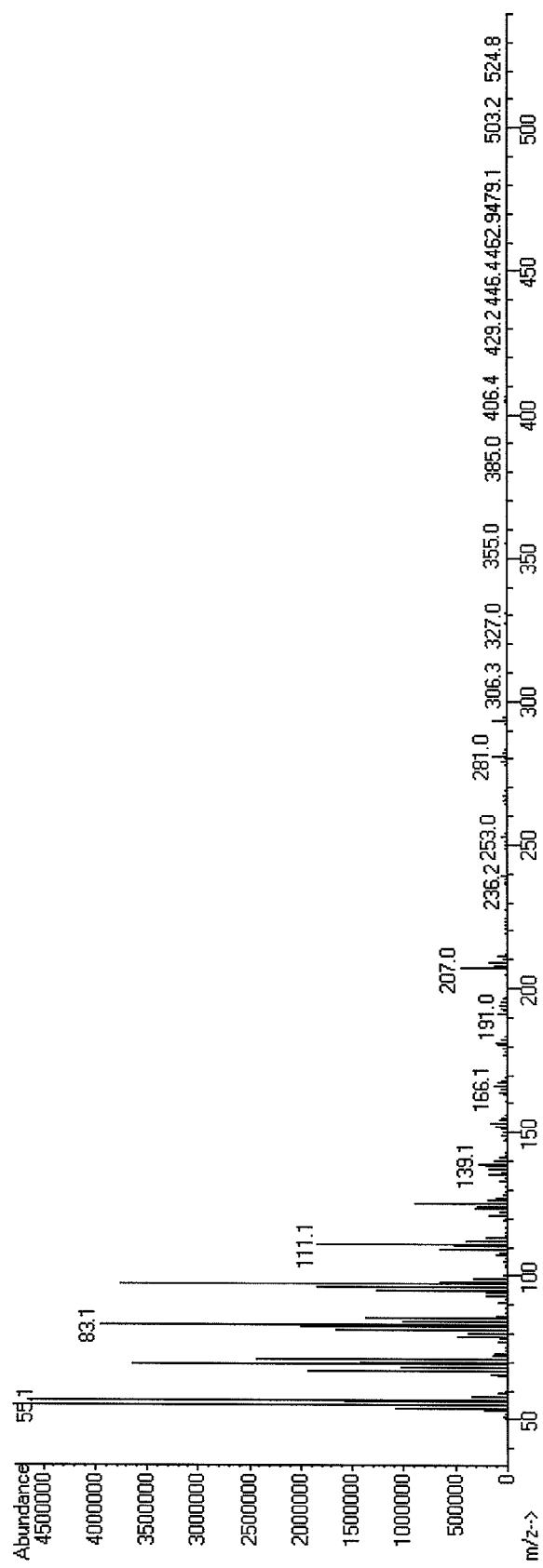
Figure 2H:
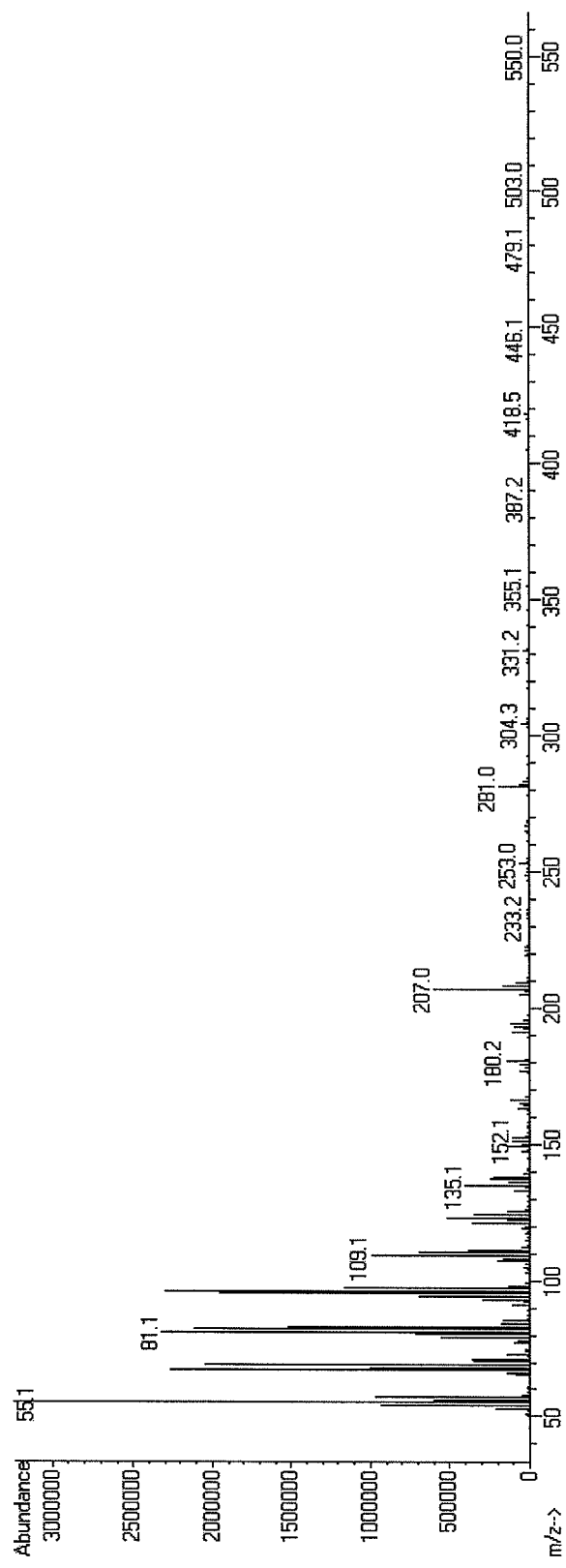
Figure 2I:
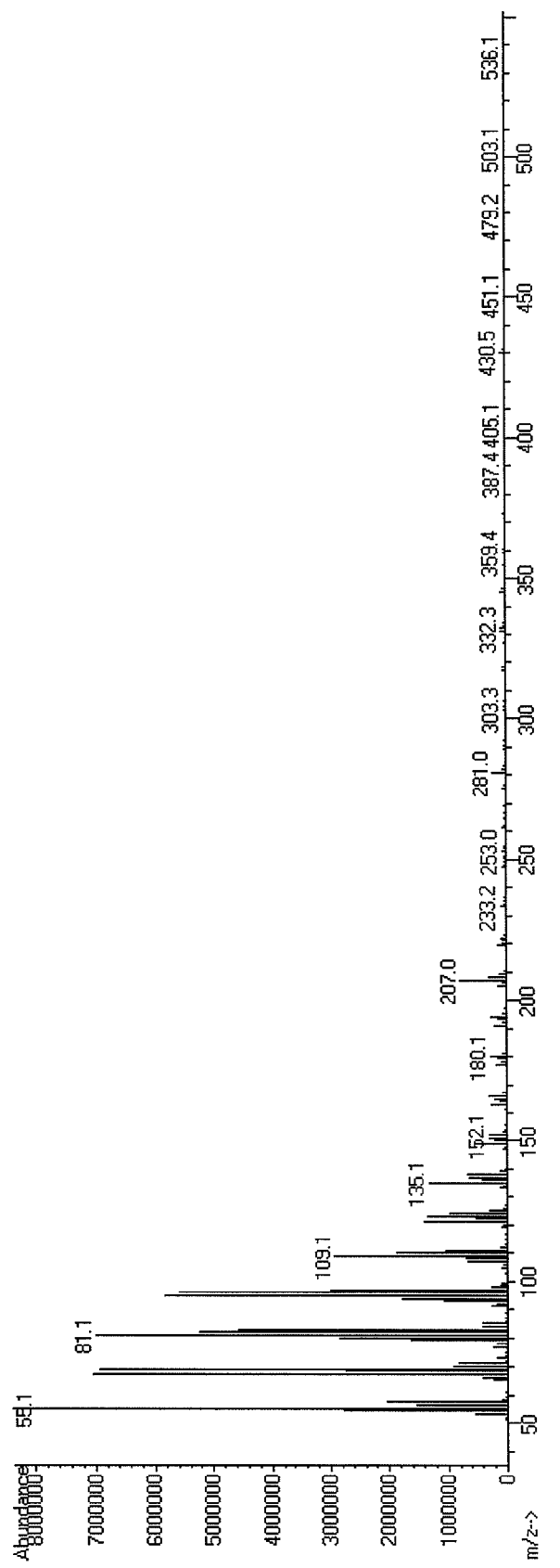
Figure 2J:
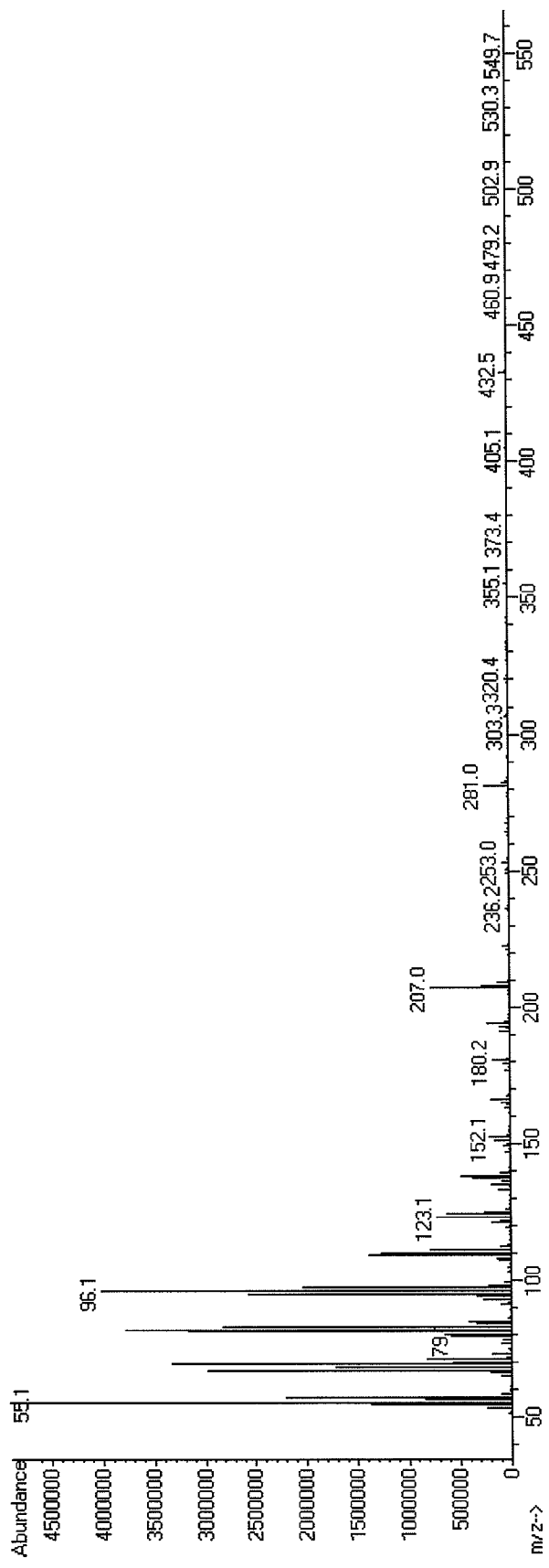

The invention is based, at least in part, on the discovery of several genes encoding proteins that are involved in the biosynthesis of hydrocarbons. Organisms transformed with one or more nucleic acid sequences encoding one or more of the proteins identified herein can be used to generate hydrocarbons, such as olefins, and hydrocarbon intermediates, such as aliphatic ketones. The terms "olefin" and "alkene" are used interchangeably herein. As described herein, these nucleic acid sequences have been identified as genes that are involved in the biosynthesis of hydrocarbons. Thus, cells that have been transformed with one or more of these genes can be used as a source for the production of hydrocarbons, including olefins, and their precursors (e.g., aliphatic ketones). This discovery provides a source for hydrocarbons that can be used as a fuel in place of limited, non-renewable hydrocarbon resources (e.g., petroleum based fuels). In addition, it permits the production of a wide range of specific olefin and aliphatic ketone products designed for particular applications. By controlling the host organism and/or the reaction substrates (e.g., controlling for chain length, branching, saturation, and/or the location of double bonds), organisms can be created that produce a wide range of hydrocarbon products, including those having particular branches or points of unsaturation.

Four genes were identified in *Stenotrophomonas maltophilia* that each encode a protein involved in the biosynthesis of hydrocarbons, such as olefins, and hydrocarbon intermediates, such as aliphatic ketones. These four genes are referred to as oleA, oleB, oleC, and oleD, and the proteins encoded by these genes are referred to as OleA, OleB, OleC, and OleD, respectively. In addition, these genes have also been found in pairs within other organisms. This pairing includes a fusion between oleB and oleC, herein referred to as oleBC, and the protein encoded by this gene is referred to as OleBC. Together, these five proteins represent a family of Ole proteins that are involved in the biosynthesis of hydrocarbons and hydrocarbon intermediates. Individually, OleA refers to a family of proteins with OleA activity, OleB refers to a family of proteins with OleB activity, OleC refers to a family of proteins with OleC activity, OleBC refers to a family of proteins with OleBC activity, and OleD refers to a family of proteins with OleD activity. One of ordinary skill in the art will appreciate that by using the information provided herein relating to the structure and function of the *S. maltophilia* ole gene sequences, other gene sequences encoding proteins having similar activity can be obtained.

Given these teachings, one of ordinary skill in the art will appreciate that additional oleA, oleB, oleC, oleBC, and oleD sequences can readily be cloned and used to make hydrocarbons and hydrocarbon intermediates. Therefore, throughout this description, reference to Ole proteins should be understood to mean all proteins displaying activity similar to that of any of the Ole family proteins, including OleA, OleB, OleC, OleBC, and OleD. Similarly, reference to OleA, OleB, OleC, OleBC, or OleD should be understood to mean all proteins displaying the respective activity of each Ole protein, including, for example, all OleA, OleB, OleC, OleBC, and OleD proteins listed in Tables 1 and 2, as well as other Ole proteins that can be identified or engineered through various bioinformatic methods or molecular techniques, such as antibody binding, nucleic acid hybridization, PCR, and other suitable methods.

In addition, throughout this description reference to ole genes should be understood to mean all genes encoding proteins displaying activity similar to that of any of the Ole family proteins, including OleA, OleB, OleC, OleBC, and OleD. Similarly, reference to oleA, oleB, oleC, oleBC, or oleD should be understood to mean all genes encoding proteins displaying the respective activity of each Ole protein, including, for example, all OleA, OleB, OleC, OleBC, and OleD proteins listed in Tables 1 and 2, as well as other Ole proteins that can be identified or engineered through various bioinformatic methods or molecular techniques, such as antibody binding, nucleic acid hybridization, PCR, and other suitable methods.

The invention provides isolated nucleic acids encoding Ole proteins. The term "isolated" with respect to nucleic acids refers to the removal of a nucleic acid from its natural environment. Moreover, an "isolated nucleic acid" is meant to include nucleic acid fragments, which are not naturally occurring as fragments and would not be found in nature. The term "isolated" is also used herein to refer to polypeptides, which are isolated from other cellular proteins and is meant to encompass both purified and recombinant polypeptides. The term "isolated" as used herein also refers to a nucleic acid or peptide that is substantially free of cellular material, viral material, or culture medium when produced by recombinant DNA techniques. The term "isolated" as used herein also refers to a nucleic acid or peptide that is substantially free of chemical precursors or other chemicals when chemically synthesized.

The terms "nucleic acid" and "nucleic acid sequence" are intended to encompass a polymer of DNA or RNA (i.e., a polynucleotide), which can be single-stranded or double-stranded and which can contain non-natural or altered nucleotides. The terms should also be understood to include, as equivalents, analogs of either RNA or DNA made from nucleotide analogs, and, as applicable to the embodiment being described, single (sense or antisense) and double-stranded polynucleotides, ESTs, chromosomes, cDNAs, mRNAs, and rRNAs.

Tables 1 and 2 provide an exemplary list of Ole proteins. In Table 1, #/#* indicates that the organism contains two homologs with the respective identities. Organisms in bold either had proven gene activity or proven olefin production. The percent identity was determined as compared to the amino acid sequence of OleA, OleB, OleC, or OleD (as indicated in Tables 1 and 2) from *S. maltophilia* ATCC17679 as calculated by BLAST™ software set to default parameters. For instance, blastn (version 2.0) software can be used to determine sequence identity between two nucleic acid sequences using default parameters (expect=10, matrix=BLOSUM62, filter=DUST (Tatusov and Lipmann, unpublished data; and Hancock and Armstrong, *Comput. Appl. Biosci.*, 10: 67-70 (1994)), gap existence cost=11, per residue gap cost=1, and lambda ratio=0.85). For comparison of two polypeptides, blastp (version 2.0) software can be used with default parameters (expect 10, filter=SEG (Wootton et al., *Computers in Chemistry*, 17: 149-163 (1993)), matrix=BLOSUM62, gap existence cost=11, per residue gap cost=1, lambda=0.85).

TABLE 1

| Organism | Protein | SEQ ID NO: | Percent Identity |
| --- | --- | --- | --- |
| Stenotrophomonas maltophilia ATCC17679 | OleA | SEQ ID NO: 152 | 100 |
| Stenotrophomonas maltophilia R551-3 | OleA | SEQ ID NO: 150 | 99 |
| Stenotrophomonas maltophilia K279a | OleA | SEQ ID NO: 151 | 99 |
| Xanthomonas campestris pv. campestris str. 8004 | OleA | SEQ ID NO: 155 | 88 |
| Xanthomonas campestris pv. campestris str. ATCC | OleA | SEQ ID NO: 157 | 88 |

TABLE 1-continued

| Organism | Protein | SEQ ID NO: | Percent Identity |
|---|---|---|---|
| 33913 | | | |
| *Xanthomonas campestris* pv. *campestris* str. B100 | OleA | SEQ ID NO: 154 | 88 |
| *Xanthomonas campestris* pv. *vesicatoria* str. 85-10 | OleA | SEQ ID NO: 153 | 88 |
| Xanthomonas axonopodis pv. *citri* str. 306 | OleA | SEQ ID NO: 158 | 87 |
| *Xanthomonas oryzae* pv. *oryzae* KACC10331 | OleA | SEQ ID NO: 160 | 87 |
| *Xanthomonas oryzae* pv. *oryzae* MAFF 311018 | OleA | SEQ ID NO: 156 | 87 |
| *Xanthomonas oryzae* pv. *oryzicola* BLS256 | OleA | SEQ ID NO: 159 | 87 |
| *Xylella fastidiosa* Dixon | OleA | SEQ ID NO: 162 | 78 |
| *Xylella fastidiosa* 9a5c | OleA | SEQ ID NO: 163 | 78 |
| *Xylella fastidiosa* Ann-1 | OleA | SEQ ID NO: 478 | 78 |
| *Xylella fastidiosa* M12 | OleA | SEQ ID NO: 161 | 78 |
| *Xylella fastidiosa* M23 | OleA | SEQ ID NO: 229 | 78 |
| *Xylella fastidiosa* Temecula1 | OleA | SEQ ID NO: 479 | 78 |
| Plesiocystis pacifica SIR-1 | OleA | SEQ ID NO: 164 | 48 |
| Chloroflexus aggregans DSM 9485 | OleA | SEQ ID NO: 165 | 45 |
| *Arthrobacter chlorophenolicus* A6 | OleA | SEQ ID NO: 224 | 45 |
| *Chloroflexus aurantiacus* J-10-fl | OleA | SEQ ID NO: 166 | 44 |
| *Clavibacter michiganensis* subsp. *Sepedonicus* | OleA | SEQ ID NO: 199 | 44 |
| *Clavibacter michiganensis* subsp. *michiganensis* NCPPB 382 | OleA | SEQ ID NO: 189 | 44 |
| Arthrobacter aurescens TC1 | OleA | SEQ ID NO: 168 | 44 |
| *Brevibacterium linens* BL2 | OleA | SEQ ID NO: 204 | 43 |
| *Desulfatibacillum alkenivorans* AK-01 | OleA | SEQ ID NO: 217 | 42 |
| *Congregibacter litoralis* KT71 | OleA | SEQ ID NO: 206 | 40 |
| Kineococcus radiotolerans SRS30216 | OleA | SEQ ID NO: 192 | 39 |
| Micrococcus luteus NCTC 2665 | OleA | SEQ ID NO: 225 | 38 |
| *Geobacter uraniumreducens* Rf4 | OleA | SEQ ID NO: 190 | 36 |
| *Pelobacter propionicus* DSM 2379 | OleA | SEQ ID NO: 182 | 36 |
| *Opitutus terrae* PB90-1 | OleA | SEQ ID NO: 203 | 36 |
| *Desulfotalea psychrophila* LSv54 | OleA | SEQ ID NO: 174 | 36 |
| *Geobacter bemidjiensis* Bem | OleA | SEQ ID NO: 212 | 35 |
| *Geobacter lovleyi* SZ | OleA | SEQ ID NO: 211 | 35 |
| *Shewanella benthica* KT99 | OleA | SEQ ID NO: 218 | 35 |
| *Shewanella loihica* PV-4 | OleA | SEQ ID NO: 188 | 35 |
| *Photobacterium profundum* SS9 | OleA | SEQ ID NO: 169 | 35 |
| *Shewanella baltica* OS155 | OleA | SEQ ID NO: 186 | 35 |
| *Shewanella baltica* OS185 | OleA | SEQ ID NO: 480 | 35 |
| *Shewanella baltica* OS195 | OleA | SEQ ID NO: 197 | 35 |
| *Shewanella baltica* OS223 | OleA | SEQ ID NO: 481 | 35 |
| *Shewanella* sp. ANA-3 | OleA | SEQ ID NO: 181 | 34 |
| *Desulfococcus oleovorans* Hxd3 | OleA | SEQ ID NO: 196 | 34 |
| *Shewanella amazonensis* SB2B | OleA | SEQ ID NO: 183 | 34 |
| *Shewanella frigidimarina* NCIMB 400 | OleA | SEQ ID NO: 179 | 34 |
| *Shewanella woodyi* ATCC 51908 | OleA | SEQ ID NO: 200 | 34 |
| *Photobacterium profundum* 3TCK | OleA | SEQ ID NO: 208 | 34 |
| *Moritella* sp. PE36 | OleA | SEQ ID NO: 215 | 34 |
| *Shewanella denitrificans* OS217 | OleA | SEQ ID NO: 176 | 34 |
| *Psychromonas ingrahamii* 37 | OleA | SEQ ID NO: 184 | 34 |
| *Shewanella pealeana* ATCC 700345 | OleA | SEQ ID NO: 195 | 34 |
| *Shewanella putrefaciens* 200 | OleA | SEQ ID NO: 482 | 34 |
| *Shewanella putrefaciens* CN-32 | OleA | SEQ ID NO: 483 | 34 |
| *Shewanella sediminis* HAW-EB3 | OleA | SEQ ID NO: 194 | 34 |
| *Shewanella* sp. W3-18-1 | OleA | SEQ ID NO: 185 | 34 |
| *Shewanella halifaxensis* HAW-EB4 | OleA | SEQ ID NO: 198 | 34 |
| *Shewanella oneidensis* MR-1 | OleA | SEQ ID NO: 172 | 34 |
| *Shewanella* sp. MR-7 | OleA | SEQ ID NO: 178 | 34 |
| *Colwellia psychrerythraea* 34H | OleA | SEQ ID NO: 175 | 34 |
| *Shewanella* sp. MR-4 | OleA | SEQ ID NO: 177 | 34 |
| *Geobacter* sp. FRC-32 | OleA | SEQ ID NO: 210 | 33 |
| *Blastopirellula marina* DSM 3645 | OleA | SEQ ID NO: 205 | 33 |
| *Planctomyces maris* DSM 8797 | OleA | SEQ ID NO: 213 | 33 |
| *Rhodopirellula baltica* SH 1 | OleA | SEQ ID NO: 173 | 33 |
| *Lentisphaera araneosa* HTCC2155 | OleA | SEQ ID NO: 214 | 33 |
| *Desulfuromonas acetoxidans* DSM 684 | OleA | SEQ ID NO: 209 | 32 |
| *Gemmata obscuriglobus* UQM 2246 | OleA | SEQ ID NO: 223 | 30 |
| *Psychromonas* sp. CNPT3 | OleA | SEQ ID NO: 207 | 30 |
| *Streptomyces ambofaciens* ATCC 23877 | OleA | SEQ ID NO: 170 | 29 |
| *Opitutaceae bacterium* TAV2 | OleA | SEQ ID NO: 216 | 37 |
| *Arthrobacter* sp. FB24 | OleA | SEQ ID NO: 167 | 27 |
| *Burkholderia oklahomensis* C6786 | OleA | SEQ ID NO: 220 | 27 |
| *Burkholderia oklahomensis* EO147 | OleA | SEQ ID NO: 219 | 27 |
| *Clostridium botulinum* A str. ATCC 3502 | OleA | SEQ ID NO: 191 | 27 |
| *Clostridium botulinum* A3 str. Loch Maree | OleA | SEQ ID NO: 202 | 27 |
| *Clostridium botulinum* B1 str. Okra | OleA | SEQ ID NO: 201 | 27 |
| *Clostridium botulinum* F str. Langeland | OleA | SEQ ID NO: 193 | 27 |
| *Maricaulis maris* MCS10 | OleA | SEQ ID NO: 180 | 27 |
| *Streptomyces ambofaciens* DSM40697 | OleA | SEQ ID NO: 171 | 27 |

TABLE 1-continued

| Organism | Protein | SEQ ID NO: | Percent Identity |
|---|---|---|---|
| Candidatus Kuenenia stuttgartiensis | OleA | SEQ ID NO: 226 | 26 |
| Clostridium botulinum Bf | OleA | SEQ ID NO: 222 | 26 |
| Clostridium botulinum NCTC 2916 | OleA | SEQ ID NO: 221 | 26 |
| Burkholderia pseudomallei 1106a | OleA | SEQ ID NO: 187 | 25 |
| Neisseria gonorrhoeae FA 1090 | OleA | SEQ ID NO: 227 | 25 |
| Stenotrophomonas maltophilia ATCC17679 | OleB | SEQ ID NO: 302 | 100 |
| Stenotrophomonas maltophilia R551-3 | OleB | SEQ ID NO: 300 | 98 |
| Stenotrophomonas maltophilia K279a | OleB | SEQ ID NO: 301 | 99 |
| Xanthomonas campestris pv. campestris str. 8004 | OleB | SEQ ID NO: 303 | 78 |
| Xanthomonas campestris pv. campestris str. ATCC 33913 | OleB | SEQ ID NO: 240 | 78 |
| Xanthomonas campestris pv. campestris str. B100 | OleB | SEQ ID NO: 236 | 78 |
| Xanthomonas campestris pv. vesicatoria str. 85-10 | OleB | SEQ ID NO: 253 | 80 |
| Xanthomonas axonopodis str. 306 | OleB | SEQ ID NO: 241 | 79 |
| Xanthomonas oryzae pv. oryzae KACC10331 | OleB | SEQ ID NO: 251 | 78 |
| Xanthomonas oryzae pv. oryzae MAFF 311018 | OleB | SEQ ID NO: 325 | 78 |
| Xanthomonas oryzae pv. oryzicola BLS256 | OleB | SEQ ID NO: 318 | 78 |
| Xylella fastidiosa Dixon | OleB | SEQ ID NO: 287 | 72 |
| Xylella fastidiosa 9a5c | OleB | SEQ ID NO: 239 | 72 |
| Xylella fastidiosa Ann-1 | OleB | SEQ ID NO: 288 | 72 |
| Xylella fastidiosa M12 | OleB | SEQ ID NO: 285 | 72 |
| Xylella fastidiosa M23 | OleB | SEQ ID NO: 326 | 72 |
| Xylella fastidiosa Temecula1 | OleB | SEQ ID NO: 243 | 72 |
| Plesiocystis pacifica SIR-1 | OleB | SEQ ID NO: 314 | 52 |
| Chloroflexus aggregans DSM 9485 | OleB | SEQ ID NO: 297 | 45 |
| Arthrobacter chlorophenolicus A6 | OleB | SEQ ID NOs: 323 and 324 | 46/36* |
| Chloroflexus aurantiacus J-10-fl | OleB | SEQ ID NO: 282 | 45 |
| Desulfatibacillum alkenivorans AK-01 | OleB | SEQ ID NO: 316 | 31 |
| Geobacter uraniumreducens Rf4 | OleB | SEQ ID NO: 274 | 53 |
| Pelobacter propionicus DSM 2379 | OleB | SEQ ID NO: 265 | 51 |
| Opitutus terrae PB90-1 | OleB | SEQ ID NO: 286 | 47 |
| Desulfotalea psychrophila LSv54 | OleB | SEQ ID NO: 249 | 39 |
| Geobacter bemidjiensis Bem | OleB | SEQ ID NO: 307 | 52 |
| Geobacter lovleyi SZ | OleB | SEQ ID NO: 298 | 51 |
| Shewanella benthica KT99 | OleB | SEQ ID NO: 317 | 56 |
| Shewanella loihica PV-4 | OleB | SEQ ID NO: 272 | 53 |
| Photobacterium profundum SS9 | OleB | SEQ ID NO: 250 | 54 |
| Shewanella baltica OS155 | OleB | SEQ ID NO: 271 | 53 |
| Shewanella baltica OS185 | OleB | SEQ ID NO: 275 | 53 |
| Shewanella baltica OS195 | OleB | SEQ ID NO: 281 | 53 |
| Shewanella baltica OS223 | OleB | SEQ ID NO: 308 | 53 |
| Shewanella sp. ANA-3 | OleB | SEQ ID NO: 263 | 53 |
| Desulfococcus oleovorans Hxd3 | OleB | SEQ ID NO: 280 | 42 |
| Shewanella amazonensis SB2B | OleB | SEQ ID NO: 266 | 53 |
| Shewanella frigidimarina NCIMB 400 | OleB | SEQ ID NO: 262 | 53 |
| Shewanella woodyi ATCC 51908 | OleB | SEQ ID NO: 284 | 54 |
| Photobacterium profundum 3TCK | OleB | SEQ ID NO: 294 | 54 |
| Moritella sp. PE36 | OleB | SEQ ID NO: 313 | 56 |
| Shewanella denitrificans OS217 | OleB | SEQ ID NO: 257 | 54 |
| Psychromonas ingrahamii 37 | OleB | SEQ ID NO: 267 | 54 |
| Shewanella pealeana ATCC 700345 | OleB | SEQ ID NO: 279 | 54 |
| Shewanella putrefaciens 200 | OleB | SEQ ID NO: 306 | 52 |
| Shewanella putrefaciens CN-32 | OleB | SEQ ID NO: 273 | 52 |
| Shewanella sediminis HAW-EB3 | OleB | SEQ ID NOs: 277 and 278 | 54/28* |
| Shewanella sp. W3-18-1 | OleB | SEQ ID NO: 270 | 52 |
| Shewanella halifaxensis HAW-EB4 | OleB | SEQ ID NO: 283 | 54 |
| Shewanella oneidensis MR-1 | OleB | SEQ ID NO: 242 | 53 |
| Shewanella sp. MR-7 | OleB | SEQ ID NO: 261 | 53 |
| Colwellia psychrerythraea 34H | OleB | SEQ ID NO: 252 | 55 |
| Shewanella sp. MR-4 | OleB | SEQ ID NO: 260 | 53 |
| Geobacter sp. FRC-32 | OleB | SEQ ID NO: 296 | 51 |
| Blastopirellula marina DSM 3645 | OleB | SEQ ID NO: 291 | 42 |
| Planctomyces maris DSM 8797 | OleB | SEQ ID NO: 309 | 40 |
| Rhodopirellula baltica SH 1 | OleB | SEQ ID NO: 244 | 36 |
| Lentisphaera araneosa HTCC2155 | OleB | SEQ ID NO: 310 | 35 |
| Desulfuromonas acetoxidans DSM 684 | OleB | SEQ ID NO: 295 | 52 |
| Gemmata obscuriglobus UQM 2246 | OleB | SEQ ID NO: 320 | 47 |
| Psychromonas sp. CNPT3 | OleB | SEQ ID NO: 293 | 51 |
| Streptomyces ambofaciens ATCC 23877 | OleB | SEQ ID NO: 234 | 39 |
| Opitutaceae bacterium TAV2 | OleB | SEQ ID NO: 315 | 43 |
| Mycobacterium vanbaalenii PYR-1 | OleB | SEQ ID NO: 268 | 31 |
| Marinobacter algicola DG893 | OleB | SEQ ID NOs: 311 and 312 | 30/31* |
| Hahella chejuensis KCTC 2396 | OleB | SEQ ID NO: 255 | 37 |
| Jannaschia sp. CCS1 | OleB | SEQ ID NO: 256 | 34 |

TABLE 1-continued

| Organism | Protein | SEQ ID NO: | Percent Identity |
|---|---|---|---|
| *Mycobacterium avium* 104 | OleB | SEQ ID NO: 264 | 33 |
| *Mycobacterium avium* subsp. *paratuberculosis* K-10 | OleB | SEQ ID NO: 245 | 33 |
| *Anaeromyxobacter* sp. Fw109-5 | OleB | SEQ ID NO: 276 | 32 |
| marine gamma proteobacterium HTCC2080 | OleB | SEQ ID NO: 299 | 32 |
| *Mycobacterium marinum* M | OleB | SEQ ID NOs: 232 and 233 | 32 |
| *Mycobacterium tuberculosis* C | OleB | SEQ ID NO: 289 | 32 |
| *Mycobacterium tuberculosis* H37Rv | OleB | SEQ ID NO: 238 | 32 |
| *Mycobacterium tuberculosis* str. *Haarlem* | OleB | SEQ ID NOs: 237 and 319 | 32 |
| *Paenibacillus* sp. JDR-2 | OleB | SEQ ID NO: 321 | 32 |
| *Burkholderia cenocepacia* AU 1054 | OleB | SEQ ID NO: 258 | 31 |
| *Burkholderia cenocepacia* PC184 | OleB | SEQ ID NO: 290 | 31 |
| *Burkholderia* sp. 383 | OleB | SEQ ID NO: 254 | 31 |
| *Ralstonia pickettii* 12J | OleB | SEQ ID NO: 304 | 31 |
| *Burkholderia ambifaria* IOP40-10 | OleB | SEQ ID NO: 322 | 30 |
| *Marinobacter aquaeolei* VT8 | OleB | SEQ ID NO: 269 | 30 |
| *Pseudoalteromonas atlantica* T6c | OleB | SEQ ID NO: 259 | 30 |
| *Rhodococcus rhodochrous* | OleB | SEQ ID NO: 246 | 30 |
| *Rhodococcus* sp. | OleB | SEQ ID NO: 230 | 30 |
| *Rhodococcus* sp. TDTM0003 | OleB | SEQ ID NO: 247 | 30 |
| *Mycobacterium* sp. GP1 | OleB | SEQ ID NO: 248 | 29 |
| *Microscilla marina* ATCC 23134 | OleB | SEQ ID NO: 305 | 28 |
| uncultured marine organism | OleB | SEQ ID NO: 235 | 27 |
| *Flavobacteriales bacterium* HTCC2170 | OleB | SEQ ID NO: 292 | 26 |
| Xanthomonas axonopodis pv. citri ATCC17679 | OleC | SEQ ID NO: 385 | 100 |
| *Stenotrophomonas maltophilia* R551-3 | OleC | SEQ ID NO: 383 | 98 |
| *Stenotrophomonas maltophilia* K279a | OleC | SEQ ID NO: 384 | 96 |
| *Xanthomonas campestris* pv. *campestris* str. 8004 | OleC | SEQ ID NO: 399 | 77 |
| *Xanthomonas campestris* pv. *campestris* str. ATCC 33913 | OleC | SEQ ID NO: 330 | 77 |
| *Xanthomonas campestris* pv. *campestris* str. B100 | OleC | SEQ ID NO: 335 | 77 |
| *Xanthomonas campestris* pv. *vesicatoria* str. 85-10 | OleC | SEQ ID NO: 348 | 77 |
| Xanthomonas axonopodis pv. citri str. 306 | OleC | SEQ ID NO: 329 | 77 |
| *Xanthomonas oryzae* pv. *oryzae* KACC10331 | OleC | SEQ ID NO: 332 | 75 |
| *Xanthomonas oryzae* pv. *oryzae* MAFF 311018 | OleC | SEQ ID NO: 349 | 75 |
| *Xanthomonas oryzae* pv. *oryzicola* BLS256 | OleC | SEQ ID NO: 395 | 74 |
| *Xylella fastidiosa* Dixon | OleC | SEQ ID NO: 373 | 73 |
| *Xylella fastidiosa* 9a5c | OleC | SEQ ID NOs: 327 and 336 | 71 |
| *Xylella fastidiosa* Ann-1 | OleC | SEQ ID NO: 374 | 71 |
| *Xylella fastidiosa* M12 | OleC | SEQ ID NO: 400 | 71 |
| *Xylella fastidiosa* M23 | OleC | SEQ ID NO: 401 | 71 |
| *Xylella fastidiosa* Temecula1 | OleC | SEQ ID NOs: 331 and 340 | 71 |
| Plesiocystis pacifica SIR-1 | OleC | SEQ ID NO: 392 | 48 |
| Chloroflexus aggregans DSM 9485 | OleC | SEQ ID NO: 381 | 46 |
| *Arthrobacter chlorophenolicus* A6 | OleC | SEQ ID NO: 398 | 33 |
| *Chloroflexus aurantiacus* J-10-fl | OleC | SEQ ID NO: 369 | 46 |
| *Desulfatibacillum alkenivorans* AK-01 | OleC | SEQ ID NO: 402 | 20 |
| *Geobacter uraniumreducens* Rf4 | OleC | SEQ ID NO: 363 | 51 |
| *Pelobacter propionicus* DSM 2379 | OleC | SEQ ID NO: 355 | 50 |
| *Opitutus terrae* PB90-1 | OleC | SEQ ID NO: 372 | 43 |
| *Desulfotalea psychrophila* LSv54 | OleC | SEQ ID NO: 344 | 41 |
| *Geobacter bemidjiensis* Bem | OleC | SEQ ID NO: 387 | 51 |
| *Geobacter lovleyi* SZ | OleC | SEQ ID NO: 382 | 50 |
| *Shewanella benthica* KT99 | OleC | SEQ ID NO: 394 | 45 |
| *Shewanella loihica* PV-4 | OleC | SEQ ID NO: 361 | 44 |
| *Photobacterium profundum* SS9 | OleC | SEQ ID NOs: 328 and 346 | 43 |
| *Shewanella baltica* OS155 | OleC | SEQ ID NO: 360 | 41 |
| *Shewanella baltica* OS185 | OleC | SEQ ID NO: 364 | 41 |
| *Shewanella baltica* OS195 | OleC | SEQ ID NO: 368 | 41 |
| *Shewanella baltica* OS223 | OleC | SEQ ID NO: 388 | 41 |
| *Shewanella* sp. ANA-3 | OleC | SEQ ID NO: 354 | 50 |
| *Desulfococcus oleovorans* Hxd3 | OleC | SEQ ID NO: 367 | 46 |
| *Shewanella amazonensis* SB2B | OleC | SEQ ID NO: 356 | 45 |
| *Shewanella frigidimarina* NCIMB 400 | OleC | SEQ ID NO: 353 | 44 |
| *Shewanella woodyi* ATCC 51908 | OleC | SEQ ID NO: 371 | 44 |
| *Photobacterium profundum* 3TCK | OleC | SEQ ID NO: 378 | 43 |
| *Moritella* sp. PE36 | OleC | SEQ ID NO: 391 | 42 |
| *Shewanella denitrificans* OS217 | OleC | SEQ ID NO: 350 | 42 |
| *Psychromonas ingrahamii* 37 | OleC | SEQ ID NO: 357 | 41 |
| *Shewanella pealeana* ATCC 700345 | OleC | SEQ ID NO: 366 | 41 |
| *Shewanella putrefaciens* 200 | OleC | SEQ ID NO: 386 | 41 |
| *Shewanella putrefaciens* CN-32 | OleC | SEQ ID NO: 362 | 41 |
| *Shewanella sediminis* HAW-EB3 | OleC | SEQ ID NO: 365 | 41 |

TABLE 1-continued

| Organism | Protein | SEQ ID NO: | Percent Identity |
|---|---|---|---|
| Shewanella sp. W3-18-1 | OleC | SEQ ID NO: 359 | 41 |
| Shewanella halifaxensis HAW-EB4 | OleC | SEQ ID NO: 370 | 40 |
| Shewanella oneidensis MR-1 | OleC | SEQ ID NO: 339 | 40 |
| Shewanella sp. MR-7 | OleC | SEQ ID NO: 352 | 40 |
| Colwellia psychrerythraea 34H | OleC | SEQ ID NO: 347 | 39 |
| Shewanella sp. MR-4 | OleC | SEQ ID NO: 351 | 39 |
| Geobacter sp. FRC-32 | OleC | SEQ ID NO: 380 | 50 |
| Blastopirellula marina DSM 3645 | OleC | SEQ ID NO: 376 | 44 |
| Planctomyces maris DSM 8797 | OleC | SEQ ID NO: 389 | 44 |
| Rhodopirellula baltica SH 1 | OleC | SEQ ID NO: 341 | 41 |
| Lentisphaera araneosa HTCC2155 | OleC | SEQ ID NO: 390 | 39 |
| Desulfuromonas acetoxidans DSM 684 | OleC | SEQ ID NO: 379 | 48 |
| Gemmata obscuriglobus UQM 2246 | OleC | SEQ ID NOs: 396 and 397 | 50/50* |
| Psychromonas sp. CNPT3 | OleC | SEQ ID NO: 377 | 39 |
| Streptomyces ambofaciens ATCC 23877 | OleC | SEQ ID NO: 333 | 36 |
| Opitutaceae bacterium TAV2 | OleC | SEQ ID NO: 393 | 41 |
| Mycobacterium vanbaalenii PYR-1 | OleC | SEQ ID NO: 358 | 34 |
| Nocardia farcinica IFM 10152 | OleC | SEQ ID NO: 345 | 43 |
| uncultured marine organism | OleC | SEQ ID NO: 334 | 31 |
| Bdellovibrio bacteriovorus HD100 | OleC | SEQ ID NO: 343 | 28 |
| Photorhabdus luminescens subsp. laumondii TTO1 | OleC | SEQ ID NO: 342 | 28 |
| Roseovarius nubinhibens ISM | OleC | SEQ ID NO: 375 | 26 |
| Stenotrophomonas maltophilia ATCC17679 | OleD | SEQ ID NO: 456 | 100 |
| Stenotrophomonas maltophilia R551-3 | OleD | SEQ ID NO: 454 | 98 |
| Stenotrophomonas maltophilia K279a | OleD | SEQ ID NO: 455 | 96 |
| Xanthomonas campestris pv. campestris str. 8004 | OleD | SEQ ID NO: 404 | 82 |
| Xanthomonas campestris pv. campestris str. ATCC 33913 | OleD | SEQ ID NO: 408 | 82 |
| Xanthomonas campestris pv. campestris str. B100 | OleD | SEQ ID NO: 406 | 80 |
| Xanthomonas campestris pv. vesicatoria str. 85-10 | OleD | SEQ ID NO: 417 | 80 |
| Xanthomonas axonopodis pv. citri str. 306 | OleD | SEQ ID NO: 409 | 80 |
| Xanthomonas oryzae pv. oryzae KACC10331 | OleD | SEQ ID NO: 415 | 79 |
| Xanthomonas oryzae pv. oryzae MAFF 311018 | OleD | SEQ ID NO: 418 | 79 |
| Xanthomonas oryzae pv. oryzicola BLS256 | OleD | SEQ ID NO: 142 | 80 |
| Xylella fastidiosa Dixon | OleD | SEQ ID NO: 444 | 71 |
| Xylella fastidiosa 9a5c | OleD | SEQ ID NO: 407 | 72 |
| Xylella fastidiosa Ann-1 | OleD | SEQ ID NO: 445 | 72 |
| Xylella fastidiosa M12 | OleD | SEQ ID NO: 145 | 72 |
| Xylella fastidiosa M23 | OleD | SEQ ID NO: 146 | 71 |
| Xylella fastidiosa Temecula1 | OleD | SEQ ID NO: 411 | 72 |
| Plesiocystis pacifica SIR-1 | OleD | SEQ ID NOs: 462 and 463 | 49/38* |
| Chloroflexus aggregans DSM 9485 | OleD | SEQ ID NOs: 451 and 452 | 55/46* |
| Arthrobacter chlorophenolicus A6 | OleD | SEQ ID NO: 144 | 38 |
| Chloroflexus aurantiacus J-10-fl | OleD | SEQ ID NO: 438 | 45 |
| Clavibacter michiganensis subsp. Sepedonicus | OleD | SEQ ID NO: 440 | 41 |
| Clavibacter michiganensis subsp. michiganensis NCPPB 382 | OleD | SEQ ID NO: 431 | 41 |
| Arthrobacter aurescens TC1 | OleD | SEQ ID NO: 427 | 37 |
| Brevibacterium linens BL2 | OleD | SEQ ID NO: 443 | 37 |
| Desulfatibacillum alkenivorans AK-01 | OleD | SEQ ID NO: 149 | |
| Congregibacter litoralis KT71 | OleD | SEQ ID NO: 447 | 47 |
| Kineococcus radiotolerans SRS30216 | OleD | SEQ ID NO: 433 | 39 |
| Micrococcus luteus NCTC 2665 | OleD | SEQ ID NO: 403 | 39 |
| Geobacter uraniumreducens Rf4 | OleD | SEQ ID NO: 432 | 59 |
| Pelobacter propionicus DSM 2379 | OleD | SEQ ID NO: 424 | 55 |
| Opitutus terrae PB90-1 | OleD | SEQ ID NO: 442 | 47 |
| Desulfotalea psychrophila LSv54 | OleD | SEQ ID NO: 413 | 46 |
| Geobacter bemidjiensis Bem | OleD | SEQ ID NO: 458 | 56 |
| Geobacter lovleyi SZ | OleD | SEQ ID NO: 453 | 56 |
| Shewanella benthica KT99 | OleD | SEQ ID NO: 464 | 49 |
| Shewanella loihica PV-4 | OleD | SEQ ID NO: 429 | 47 |
| Photobacterium profundum SS9 | OleD | SEQ ID NO: 414 | 50 |
| Shewanella baltica OS155 | OleD | SEQ ID NO: 148 | 42 |
| Shewanella baltica OS185 | OleD | SEQ ID NO: 484 | 44 |
| Shewanella baltica OS195 | OleD | SEQ ID NO: 485 | 43 |
| Shewanella baltica OS223 | OleD | SEQ ID NO: 486 | 43 |
| Shewanella sp. ANA-3 | OleD | SEQ ID NO: 423 | 50 |
| Desulfococcus oleovorans Hxd3 | OleD | SEQ ID NOs: 436 and 437 | 47/40* |
| Shewanella amazonensis SB2B | OleD | SEQ ID NO: 425 | 46 |
| Shewanella frigidimarina NCIMB 400 | OleD | SEQ ID NO: 422 | 50 |
| Shewanella woodyi ATCC 51908 | OleD | SEQ ID NO: 441 | 46 |
| Photobacterium profundum 3TCK | OleD | SEQ ID NO: 449 | 48 |
| Moritella sp. PE36 | OleD | SEQ ID NO: 461 | 45 |

TABLE 1-continued

| Organism | Protein | SEQ ID NO: | Percent Identity |
|---|---|---|---|
| Shewanella denitrificans OS217 | OleD | SEQ ID NO: 419 | 49 |
| Psychromonas ingrahamii 37 | OleD | SEQ ID NO: 426 | 48 |
| Shewanella pealeana ATCC 700345 | OleD | SEQ ID NO: 435 | 46 |
| Shewanella putrefaciens 200 | OleD | SEQ ID NO: 457 | 47 |
| Shewanella putrefaciens CN-32 | OleD | SEQ ID NO: 430 | 46 |
| Shewanella sediminis HAW-EB3 | OleD | SEQ ID NO: 434 | 46 |
| Shewanella sp. W3-18-1 | OleD | SEQ ID NO: 428 | 46 |
| Shewanella halifaxensis HAW-EB4 | OleD | SEQ ID NO: 439 | 48 |
| Shewanella oneidensis MR-1 | OleD | SEQ ID NO: 410 | 48 |
| Shewanella sp. MR-7 | OleD | SEQ ID NO: 421 | 49 |
| Colwellia psychrerythraea 34H | OleD | SEQ ID NO: 416 | 44 |
| Shewanella sp. MR-4 | OleD | SEQ ID NO: 420 | 49 |
| Geobacter sp. FRC-32 | OleD | SEQ ID NO: 450 | 55 |
| Blastopirellula marina DSM 3645 | OleD | SEQ ID NO: 446 | 51 |
| Planctomyces maris DSM 8797 | OleD | SEQ ID NO: 459 | 47 |
| Rhodopirellula baltica SH 1 | OleD | SEQ ID NO: 412 | 40 |
| Lentisphaera araneosa HTCC2155 | OleD | SEQ ID NO: 460 | 40 |
| Desulfuromonas acetoxidans DSM 684 | OleD | SEQ ID NO: 487 | 51 |
| Gemmata obscuriglobus UQM 2246 | OleD | SEQ ID NO: 143 | 52 |
| Psychromonas sp. CNPT3 | OleD | SEQ ID NO: 448 | 48 |
| Streptomyces ambofaciens ATCC 23877 | OleD | SEQ ID NO: 405 | 44 |
| Opitutaceae bacterium TAV2 | OleD | SEQ ID NO: 147 | 28 |

TABLE 2

| Organism | Protein | Seq ID No | Percent Identity OleB | Percent Identity OleC |
|---|---|---|---|---|
| Clavibacter michiganensis subsp. Sepedonicus | OleBC | SEQ ID NO: 138 | 33 | 36 |
| Clavibacter michiganensis subsp. michiganensis NCPPB 382 | OleBC | SEQ ID NO: 136 | 33 | 35 |
| Arthrobacter aurescens TC1 | OleBC | SEQ ID NO: 135 | 37 | 33 |
| Brevibacterium linens BL2 | OleBC | SEQ ID NO: 139 | 27 | 34 |
| Kineococcus radiotolerans SRS30216 | OleBC | SEQ ID NO: 137 | 31 | 34 |
| Micrococcus luteus NCTC 2665 | OleBC | SEQ ID NO: 141 | 32 | 32 |
| Congregibacter litoralis KT71 | OleBC | SEQ ID NO: 140 | 32 | 33 |

The invention provides five protein families involved in the biosynthesis of hydrocarbons, the OleA, OleB, OleC, OleBC, and OleD protein families, which collectively are referred to as the Ole protein family. Bioinformatic programs, such as the BLAST programs (provided by the NIH, Bethesda, Md.), were used to identify protein and nucleotide sequences that belong to the OleA, OleB, OleC, OleBC, and OleD protein families.

In order to identify proteins most likely to be involved in hydrocarbon biosynthesis, additional constraints were applied to the bioinformatic analysis. Hydrocarbon biosynthesis is not performed by a single Ole protein. Therefore, organisms that contain all four Ole proteins may be more likely to produce hydrocarbons. Accordingly, bioinformatic analysis was performed on more than 940 bacterial genomes, as well as greater than 100 archaeal and eukaryotic genomes. This search revealed 67 bacterial genomes that contain all four ole hydrocarbon synthesis genes: *Stenotrophomonas maltophilia* R551-3, *Stenotrophomonas maltophilia* K279a, *Arthrobacter aurescens* TC1, *Arthrobacter chlorophenolicus* A6, *Blastopirellula marina* DSM 3645, *Brevibacterium linens* BL2, *Desulfococcus oleovorans* Hxd3, *Chloroflexus aggregans* DSM 9485, *Chloroflexus aurantiacus* J-10-fl, *Clavibacter michiganensis* subsp. *michiganensis* NCPPB 382, *Clavibacter michiganensis* subsp. *Sepedonicus, Colwellia psychrerythraea* 34H, *Congregibacter litoralis* KT71, *Desulfotalea psychrophila* LSv54, *Desulfuromonas acetoxidans* DSM 684, *Gemmata obscuriglobus* UQM 2246, *Geobacter bemidjiensis* Bem, *Geobacter lovleyi* SZ, *Geobacter* sp. FRC-32, *Geobacter uraniumreducens* Rf4, *Kineococcus radiotolerans* SRS30216, *Lentisphaera araneosa* HTCC2155, *Micrococcus luteus* NCTC 2665, *Moritella* sp. PE36, *Opitutus terrae* PB90-1, *Pelobacter propionicus* DSM 2379, *Photobacterium profundum* 3TCK, *Photobacterium profundum* SS9, *Planctomyces maris* DSM 8797, *Plesiocystis pacifica* SIR-1, *Psychromonas ingrahamii* 37, *Psychromonas* sp. CNPT3, *Rhodopirellula baltica* SH 1, *Shewanella amazonensis* SB2B, *Shewanella baltica* OS155, *Shewanella baltica* OS185, *Shewanella baltica* OS195, *Shewanella baltica* OS223, *Shewanella benthica* KT99, *Shewanella denitrificans* OS217, *Shewanella frigidimarina* NCIMB 400, *Shewanella halifaxensis* HAW-EB4, *Shewanella loihica* PV-4, *Shewanella oneidensis* MR-1, *Shewanella pealeana* ATCC 700345, *Shewanella putrefaciens* 200, *Shewanella putrefaciens* CN-32, *Shewanella sediminis* HAW-EB3, *Shewanella* sp. ANA-3, *Shewanella* sp. MR-4, *Shewanella* sp. MR-7, *Shewanella* sp. W3-18-1, *Shewanella woodyi* ATCC 51908, *Streptomyces ambofaciens* ATCC 23877, *Xanthomonas axonopodis* pv. citri str. 306, *Xanthomonas campestris* pv. *campestris* str. 8004, *Xanthomonas campestris* pv. *campestris* str. B100, *Xanthomonas campestris* pv. *campestris* str. ATCC 33913, *Xanthomonas campestris* pv. *vesicatoria* str. 85-10, *Xanthomonas oryzae* pv. *oryzae* KACC10331, *Xanthomonas oryzae* pv. *oryzae* MAFF 311018, *Xanthomonas oryzae* pv. *oryzicola* BLS256, *Xylella* fastidiosa 9a5c, *Xylella fastidiosa* Ann-1, *Xylella fastidiosa* Dixon, *Xylella fastidiosa* M12, *Xylella fastidiosa* M23, and *Xylella fastidiosa* Temecula1.

Previous reports have attempted to characterize the ability of various organisms to produce hydrocarbons, but these reports could not be confirmed (see, e.g., Jones et al., *J. Gen. Microbiol.,* 59: 145-152 (1969), Ladygina et al., *Process Biochemistry,* 41:1001-1014 (2006)). While very little is published about the ability of organisms to produce nonisoprenoid hydrocarbons, there are four organisms that have been shown in the literature to produce the types of olefins described herein: *Stenotrophomonas maltophilia, Kineococcus radiotolerans, Chloroflexus* species, and various *Micrococcus* species, including the recently sequenced *Micrococcus luteus* (Tornabene et al., *Can. J. Microbiol.,* 24: 525-532 (1978); Suen et al., *Journal of Industrial Microbiology,* 2: 337-348 (1988); Morrison et al., *J. Bacteriol,* 108: 353-358 (1971); van der Meer et al., *Org. Geochem.,* 30: 1585-1587 (1999); Albro et al., *Biochemistry,* 8: 394-404 (1969); Philips et al., *Int. J. Syst. Eva Microbiol.,* 52: 933-938 (2002)).

Bioinformatics searching independently identified the four ole genes in *Stenotrophomonas maltophilia* (R551-3 and K279a), *Kineococcus radiotolerans, Chloroflexus aggregans, Chloroflexus aurantiacus*, and *Micrococcus luteus*. In addition, the production of hydrocarbons (e.g., olefins) from these organisms has been confirmed. Specifically, the Ole proteins from several of these organisms were tested for their ability to produce hydrocarbons. Two organisms that are known to produce hydrocarbons and two organisms that have not been reported to produce hydrocarbons, but were identified in the bioinformatic analysis, were selected and tested for their ability to produce hydrocarbons when expressed in *E. coli.*

Example 6 shows that OleA, OleC, and OleD protein sequences from *Stenotrophomonas maltophilia, Xanothomonas axonopodis*, and *Chloroflexus aggregans* function to produce hydrocarbons when expressed in a host, such as *E. coli* or *Bacillus megaterium*. In addition, the OleC protein sequence from *Plesiocystis pacifica*, also produces hydrocarbons when expressed with oleA and oleD in *E. coli.*

To confirm that these genes confer hydrocarbon production ability in *Stenotrophomonas maltophilia*, deletion mutations of oleA, oleC, and oleD were made in a hydrocarbon producing strain of *Stenotrophomonas maltophilia*. Deletion mutants of *Stenotrophomonas maltophilia* that are missing oleA do not produce any hydrocarbons, Deletion mutants of *Stenotrophomonas maltophilia* that are missing either oleC or oleD do not produce hydrocarbons, but produce aliphatic ketones instead.

By using bioinformatics, Ole amino acid motifs can be designed by identifying conserved regions of each Ole protein. These amino acid motifs can be designed by protein alignments followed by visual inspection of the protein sequences. These amino acid motifs can then be used to identify proteins that have similar biological functions as the Ole proteins. Several programs well known in the art can use the amino acid motifs to identify proteins that belong to the family of functional proteins. For example, one such publicly available program is http://motif.genome.jp/motif2.html (see Example 7).

Based on the experimental data, it was predicted that organisms that contain all four ole genes most likely have the ability to produce hydrocarbons. Therefore, the amino acid motifs were created by compiling all OleA, OleB, OleC, and OleD protein sequences from the sixty-seven organisms (see, e.g., Table 1) that contain all four Ole proteins. For protein fusions, such as the OleBC proteins, the OleB sections were aligned with the OleB protein sequences and the OleC sections were aligned with the OleC protein sequence. Organisms with partial genome sequences or possible genomic recombinations were not included in Table 1 and, therefore, were not used to design these amino acid motifs. Based upon the conserved regions of these sixty-seven organisms containing all four ole genes, it is predicted that other polypeptide sequences containing these amino acid motifs may be functional Ole proteins. The amino acid motifs designed from the sixty-seven organism containing the four ole genes are shown in Tables 3-6. In all of the depicted motifs, subscript numbering indicates the position of the amino acid within the motif. X represents any amino acid (e.g., any naturally occurring amino acid), and bracketed items reflect a choice of amino acid residues for the indicated position. For example, $[LF]_1$ means either L or F at residue position 1.

TABLE 3

| Motifs for OleA protein family | |
|---|---|
| SEQ ID NO: 64 | $[LF]_{1}-X_{2}-X_{3}-[IVLM]_{4}-[ATSV]_{5}-G_{6}-[IV]_{7}-X_{8}-[EAHS]_{9}-R_{10}-R_{11}-X_{12}-W_{13}$ |
| SEQ ID NO: 65 | $[TAC]_{1}-[SGT]_{2}-V_{3}-X_{4}-[RQ]_{5}-X_{6}-X_{7}-X_{8}-E_{9}-P_{10}-[SA]_{11}-[TV]_{12}-A_{13}$ |
| SEQ ID NO: 66 | $D_{1}-[VIL]_{2}-X_{3}-N_{4}-A_{5}-C_{6}-L_{7}-[AG]_{8}$ |
| SEQ ID NO: 67 | $[LM]_{1}-T_{2}-X_{3}-G_{4}-[SCA]_{5}-G_{6}$ |
| SEQ ID NO: 68 | $M_{1}-X_{2}-T_{3}-[DSN]_{4}-X_{5}-X_{6}-X_{7}-X_{8}-X_{9}-X_{10}-X_{11}-G_{12}$ |
| SEQ ID NO: 69 | $[LF]_{1}-X_{2}-X_{3}-G_{4}-[DE]_{5}-X_{6}-X_{7}-X_{8}-X_{9}-[LM]_{10}-G_{11}-[IVM]_{12}-G_{13}-S_{14}-G_{15}-[LI]_{16}-N_{17}-[CATS]_{18}-X_{19}-[MAV]_{20}-X_{21}-X_{22}-X_{23}-X_{24}-W_{25}$ |

TABLE 4

| Motifs for OleD protein family | |
|---|---|
| SEQ ID NO: 70 | $[ILVA]_{1}-[LFV]_{2}-V_{3}-T_{4}-G_{5}-[GAC]_{6}-[GSN]_{7}-G_{8}-[FLM]_{9}-[LV]_{10}-G_{11}-X_{12}-X_{13}-[LVIT]_{14}-[CVA]_{15}-X_{16}-X_{17}-L_{18}-X_{19}-X_{20}-X_{21}-G_{22}$ |
| SEQ ID NO: 71 | $H_{1}-[NVTL]_{2}-[AG]_{3}-[AS]_{4}-[KLVIQR]_{5}-[VAPI]_{6}-[GSD]_{7}-[AVLIM]_{8}-X_{9}-G_{10}$ |

TABLE 5

| Motifs for OleC protein family | |
|---|---|
| SEQ ID NO: 72 | $G_{1}-X_{2}-X_{3}-[DE]_{4}-[LM]_{5}-[PACS]_{6}-[TAG]_{7}-F_{8}-P_{9}-[LP]_{10}-F_{11}-[ASG]_{12}-L_{13}-F_{14}-X_{15}-X_{16}-A_{17}-[LM]_{18}-G_{19}$ |
| SEQ ID NO: 73 | $H_{1}-R_{2}-M_{3}-G_{4}-D5-[VL]_{6}-[GA]_{7}-X_{8}-X_{9}-D_{10}-X(5)_{11-15}-W_{16}-[FM]_{17}-[CY]_{18}-G_{19}-R_{20}-K_{21}-X_{22}-[HQ]_{23}-[R]_{24}-V_{25}$ |
| SEQ ID NO: 74 | $L_{1}-X_{2}-H_{3}-X_{4}-X_{5}-F_{6}-P_{7}-[VM]_{8}-D_{9}-[IV]_{10}-R_{11}-H_{12}-N_{13}-[AS]_{14}-K_{15}-I_{16}-[GF]_{17}-R_{18}-E_{19}-X_{20}-L_{21}-A_{22}-X_{23}-W_{24}-A_{25}$ |

TABLE 6

| Motifs for OleB protein family | |
|---|---|
| SEQ ID NO: 91 | $[VILMF]_{1}-[VL]_{2}-[MLFC]_{3}-[VLI]_{4}-H_{5}-G_{6}-N_{7}-P_{8}-[ST]_{9}-W_{10}-[SCGT]_{11}-[FYL]_{12}-[YFLAB]_{13}-[WY]_{14}-R_{15}$ |

TABLE 6-continued

Motifs for OleB protein family

SEQ ID NO: 92  $[RQ]_1-[CVILT]_2-[IVL]_3-[VAC]_4-[PVML]_5-D_6-[HNL]_7-[IMLPV]_8-G_9-[MCF]_{10}-G_{11}-[LFRYKT]_{12}-S_{13}-[DERS]_{14}-[KR]_{15}-[PL]_{16}-[DGSAR]_{17}$

SEQ ID NO: 93  $[TIHDS]_1-[LF]_2-[AVIMFC]_3-[VLA]_4-H_5-D_6-W_7-G_8-G_9-[MAFP]_{10}-[IL]_{11}-G_{12}-[FMTLVC]_{13}-[GAS]_{14}-[WYFALMC]_{15}-[AM]_{16}$

SEQ ID NO: 94  $[RKQN]_1-[LIVCF]_2-[VGI]_3-[IVLMCA]_4-[LTCMF]_5-N_6-T_7-[AGVS]_8-[AVG]_9-F_{10}$

SEQ ID NO: 95  $[NDHKE]_1-R_2-[IVR]_3-[SA]_4-[TIV]_5-X_6-X_7-[FA]_8-[VIM]_9-[QGHLKR]_{10}-[DAT]_{11}-I_{12}-[PA]_{13}-[LCR]_{14}$

SEQ ID NO: 96  $[WF]_1-G_2-X_3-[RQKYH]_4-D_5-[FIWP]_6-[VC]_7-F_8-[DNTR]_9-X_{10}-X_{11}-[FYCL]_{12}-[LFY]_{13}$

SEQ ID NO: 97  $[GN]_1-H_2-Y_3-[VIL]_4-[LVI]_5-E_6-D_7$

Additional amino acid motifs were developed by further considering published literature which identified organisms as producing hydrocarbons in combination with bioinformatic data showing that these organisms also contained all four ole genes. Moreover, these motifs were developed using experimental data that demonstrated that the particular organisms tested with all four ole genes produced hydrocarbons. These amino acid motifs are shown in Tables 7-9.

TABLE 7

Motifs for OleA

SEQ ID NO: 98  $V_1-X_2-[RQ]_3-[DPAR]_4-[YHTN]_5-L_6-E_7-P_8-[SA]_9-[TV]_{10}-A_{11}$

SEQ ID NO: 99  $F_1-D_2-[VIL]_3-X_4-N_5-A_6-C_7-L_8-X_9-[FW]_{10}-X_{11}-N_{12}-G_{13}$

SEQ ID NO: 100  $I_1-[DER]_2-Y_3-A_4-[LV]_5-[IV]_6-[VL]_7-X_8-[GA]_9-E_{10}$

SEQ ID NO: 101  $F_1-X_2-X_3-X_4-G_5-N_6-[IV]_7-G_8-P_9-[AI]_{10}-X_{11}-X_{12}-P_{13}$

SEQ ID NO: 102  $[LM]_1-G_2-[IV]_3-G_4-S_5-G_6-L_7-N_8-X_9-[SAG]_{10}-M_{11}$

TABLE 8

Motifs for OleC

SEQ ID NO: 103  $A_1-A_2-[IV]_3-X_4-F_5-T_6-S_7-G_8-S_9-T_{10}-G_{11}-X_{12}-[PA]_{13}-K_{14}-G_{15}-V_{16}$

SEQ ID NO: 104  $F_1-X_2-X_3-F_4-A_5-L_6-X_7-X_8-X_9-A_{10}-L_{11}-G_{12}-X_{13}-[TV]_{14}-[ST]_{15}-X_{16}-X_{17}-P_{18}-X_{19}-X_{20}-D_{21}-[PV]_{22}$

SEQ ID NO: 105  $[TP]_1-P_2-Y_3-G_4-X_5-T_6-E_7-X_8-L_9-P_{10}-V_{11}$

SEQ ID NO: 106  $H_1-R_2-X_3-G_4-D_5-X_6-G_7-[YHMW]_8-X_9-D_{10}-X_{11}-X_{12}-G_{13}-R_{14}-[LI]_{15}-W_{16}-[VF]_{17}-X_{18}-G_{19}-R_{20}-[KL]_{21}$

SEQ ID NO: 107  $A_1-[LI]_2-[VT]_3-G_4-[VPI]_5-[GQ]_6-X_7-X_8-G_9-[AQT]_{10}-[QV]_{11}-X_{12}-[PAV]_{13}-[VA]_{14}$

TABLE 8-continued

Motifs for OleC

SEQ ID NO: 108  $P_1-[VT]_2-D_3-I_4-R_5-H_6-N_7-A_8-K_9-I_{10}-X_{11}-R_{12}-X_{13}-X_{14}-L_{15}-[AR]_{16}-X_{17}-W_{18}-A_{19}-X_{20}-X_{21}-X_{22}-L_{23}$

TABLE 9

MOTIF for OleD

SEQ ID NO: 109  $L_1-V_2-T_3-G_4-[AG]_5-[GNS]_6-G_7-[FLM]_8-[LV]_9-G_{10}-[QRAG]_{11}-X_{12}-[LVT]_{13}-[CVA]_{14}-[RE]_{15}-X_{16}-L_{17}$

SEQ ID NO: 110  $[VIA]_1-X_2-[ATG]_3-[IV]_4-X_5-H_6-X_7-X_8-A_9-K_{10}-[AV]_{11}-[GS]_{12}-X_{13}-X_{14}-G_{15}$

SEQ ID NO: 111  $[YHM]_1-[TV]_2-S_3-[TS]_4-P_5-S_6-V_7-[VTA]_8-[HI]_9$

SEQ ID NO: 112  $[AR]_1-[TV]_2-X_3-[AV]_4-[LV]_5-R_6-P_7-[RH]_8-[LI]_9-X_{10}-[WL]_{11}-G_{12}-P_{13}-[GR]_{14}-D_{15}$

SEQ ID NO: 113  $G_1-[RE]_2-A_3-[YLFV]_4-[FV]_5-[IV]_6-X_7-[NQ]_8-[GE]_9-X_{10}-P_{11}$

SEQ ID NO: 114  $E_1-[PV]_2-P_3-[LM]_4-T_5-[RE]_6-[FL]_7-[LM]_8-[AV]_9$

SEQ ID NO: 115  $P_1-X_2-[IV]_3-[SP]_4-[IL]_5-[ED]_6-E_7-G_8-[LF]_9-[RQHA]_{10}-R_{11}$

Finally, additional amino acid motifs were developed by aligning Ole protein sequences from organisms whose ole genes were heterologously expressed in *E. coli* and confirmed as having a role in hydrocarbon production (see, e.g., Example 6). These amino acid motifs are shown in Tables 10-12.

TABLE 10

Motifs for OleA

SEQ ID NO: 116  $D_1-Y_2-L_3-E_4-P_5-S_6-T_7-A_8$

SEQ ID NO: 117  $F_1-D_2-V_3-X_4-N_5-A_6-C_7-L_8-X_9-F_{10}-X_{11}-N_{12}-G_{13}-M_{14}$

SEQ ID NO: 118  $Y_1-A_2-L_3-[IV]_4-V_5-D_6-G_7-E_8$

SEQ ID NO: 119  $F_1-X_2-X_3-X_4-G_5-N_6-I_7-G_8-P_9-A_{10}-X_{11}-X_{12}-P_{13}-I_{14}$

SEQ ID NO: 120  $L_1-G_2-I_3-G_4-S_5-G_6-L_7-N_8-C_9-S_{10}-M_{11}$

TABLE 11

Motifs for OleC

SEQ ID NO: 121  $A_1-A_2-I_3-[LV]_4-F_5-T_6-S_7-G_8-S_9-T_{10}-G_{11}-[VTP]_{12}-P_{13}-K_{14}-G_{15}-V_{16}-[VL]_{17}-Y_{18}-[RT]_{19}-H_{20}-[RG]_{21}$

SEQ ID NO: 122  $P_1-[AT]_2-F_3-P_4-[LP]_5-F_6-A_7-L_8-F_9-[ND]_{10}-[VP]_{11}-A_{12}-L_{13}-G_{14}-[LMV]_{15}-T_{16}-[ST]_{17}-[AV]_{18}-[IL]_{19}-P_{20}$

SEQ ID NO: 123  $[TP]_1-P_2-Y_3-G_4-A_5-T_6-E_7-X_8-L_9-P_{10}-V_{11}$

TABLE 11-continued

Motifs for OleC

| | |
|---|---|
| SEQ ID NO: 124 | $H_1$-$R_2$-$M_3$-$G_4$-$D_5$-$X_6$-$G_7$-[YW]$_8$-$X_9$-$D_{10}$-$X_{11}$-$X_{12}$-$G_{13}$-$R_{14}$-[LI]$_{15}$-$W_{16}$-$F_{17}$-[CY]$_{18}$-$G_{19}$-$R_{20}$-$K_{21}$ |
| SEQ ID NO: 125 | $A_1$-$L_2$-$V_3$-$G_4$-[VP]$_5$-[GQ]$_6$-$X_7$-$X_8$-$G_9$-[AQ]$_{10}$-[QV]$_{11}$-$X_{12}$-[PA]$_{13}$-[VA]$_{14}$ |
| SEQ ID NO: 126 | $F_1$-$P_2$-$V_3$-$D_4$-$I_5$-$R_6$-$H_7$-$N_8$-$A_9$-$K_{10}$-$I_{11}$-[GF]$_{12}$-$R_{13}$-[EG]$_{14}$-$X_{15}$-$L_{16}$-[AR]$_{17}$-[VA]$_{18}$-$W_{19}$-$A_{20}$-$X_{21}$-$X_{22}$-$X_{23}$-$L_{24}$ |

TABLE 12

Motifs for OleD

| | |
|---|---|
| SEQ ID NO: 127 | $L_1$-$V_2$-$T_3$-$G_4$-$G_5$-[GN]$_6$-$G_7$-$F_8$-[LV]$_9$-$G_{10}$-$X_{11}$-$X_{12}$-$L_{13}$-$X_{14}$-$X_{15}$-$X_{16}$-$L_{17}$ |
| SEQ ID NO: 128 | $G_1$-[VI]$_2$-[DT]$_3$-$A_4$-$V_5$-$F_6$-$H_7$-$X_8$-$X_9$-$A_{10}$-$K_{11}$-$A_{12}$-$G_{13}$-$X_{14}$-$W_{15}$-$G_{16}$-$X_{17}$-$Y_{18}$-$D_{19}$-$X_{20}$-$X_{21}$-$X_{22}$-$X_{23}$-$A_{24}$-$N_{25}$-$V_{26}$ |
| SEQ ID NO: 129 | $Y_1$-$T_2$-$S_3$-$T_4$-$P_5$-$S_6$-$V_7$-[VT]$_8$ |
| SEQ ID NO: 130 | $A_1$-$T_2$-$V_3$-$A_4$-$L_5$-$R_6$-$P_7$-[RH]$_8$-$L_9$-$I_{10}$-$W_{11}$-$G_{12}$-$P_{13}$-[GR]$_{14}$-$D_{15}$ |
| SEQ ID NO: 131 | $G_1$-$R_2$-$A_3$-$Y_4$-$F_5$-$I_6$-$X_7$-$X_8$-$X_9$-$X_{10}$-$P_{11}$ |
| SEQ ID NO: 132 | $L_1$-$R_2$-$L_3$-$X_4$-$G_5$-$E_6$-$X_7$-$P_8$-$L_9$-$T_{10}$-$R_{11}$ |
| SEQ ID NO: 133 | $R_1$-$D_2$-$F_3$-$G_4$-$Y_5$-$X_6$-$P_7$-$X_8$-$X_9$-$S_{10}$-$I_{11}$-$E_{12}$-$E_{13}$-$G_{14}$-$L_{15}$-[RQ]$_{16}$-$R_{17}$ |

The invention is directed to an isolated nucleic acid encoding a polypeptide comprising an OleA, OleB, OleC, or OleD amino acid motif sequence. For example, the isolated nucleic acid can encode a polypeptide comprising an amino acid sequence selected from the group consisting of SEQ ID NOs: 64-74 and 91-133.

The isolated nucleic acid can encode a polypeptide comprising an OleA amino acid motif sequence. For example, the isolated nucleic acid can encode a polypeptide comprising an amino acid sequence selected from the group consisting of SEQ ID NOs: 64-69, 98-102, and 116-120. The isolated nucleic acid can encode a polypeptide comprising an OleB amino acid motif sequence. For example, the isolated nucleic acid can encode a polypeptide comprising an amino acid sequence selected from the group consisting of SEQ ID NOs: 91-97. The isolated nucleic acid can encode a polypeptide comprising an OleC amino acid motif sequence. For example, the isolated nucleic acid can encode a polypeptide comprising an amino acid sequence selected from the group consisting of SEQ ID NOs: 72-74, 103-108, and 121-126. The isolated nucleic acid can encode a polypeptide comprising an OleD amino acid motif sequence. For example, the isolated nucleic acid can encode a polypeptide comprising an amino acid sequence selected from the group consisting of SEQ ID NOs: 70, 71, 109-115, and 127-133.

The isolated nucleic acid can encode a polypeptide comprising more than one OleA, OleB, OleC, or OleD amino acid motif sequence. For example, the isolated nucleic acid can encode a polypeptide comprising one, two, three, or four Ole amino acid motif sequences. For example, the isolated nucleic acid can encode a polypeptide comprising an OleB amino acid motif sequence and an OleC amino acid motif sequence.

Alternatively, the isolated nucleic acid can encode more than one polypeptide comprising an Ole amino acid motif sequence. For instance, the isolated nucleic acid can encode a first polypeptide and a second polypeptide, wherein each of the first and second polypeptides comprises an Ole amino acid motif sequence or wherein each of the first and second polypeptides comprises an amino acid sequence selected from the group consisting of SEQ ID NOs: 64-74 and 91-133. The isolated nucleic acid can encode a first polypeptide, a second polypeptide, and a third polypeptide, wherein each of the first, second, and third polypeptides comprises an Ole amino acid motif sequence. For example, the isolated nucleic acid can encode a first polypeptide, a second polypeptide, and a third polypeptide, wherein each of the first, second, and third polypeptides comprises an amino acid sequence selected from the group consisting of SEQ ID NOs: 64-74 and 91-133. The isolated nucleic acid can encode a first polypeptide, a second polypeptide, a third polypeptide, and a fourth polypeptide, wherein each of the first, second, third, and fourth polypeptides comprises an Ole amino acid motif sequence. For example, the isolated nucleic acid can encode a first polypeptide, a second polypeptide, a third polypeptide, and a fourth polypeptide, wherein each of the first, second, third, and fourth polypeptides comprises an amino acid sequence selected from the group consisting of SEQ ID NOs: 64-74 and 91-133.

Preferably, the isolated nucleic acid encodes a polypeptide of no more than 1500 amino acid residues comprising an Ole amino acid motif sequence. For example, the isolated nucleic acid can encode a polypeptide of no more than 1500 amino acid residues comprising an amino acid sequence selected from the group consisting of SEQ ID NOs: 64-74 and 91-133. In another embodiment, each of the first and second polypeptides is no more than 1500 amino acid residues, each of the first, second, and third polypeptides is no more than 1500 amino acid residues, or each of the first, second, third and fourth polypeptides is no more than 1500 amino acid residues.

Bioinformatic analysis of the ole genes revealed that the genes are often found within a 5000 to 10000 base pair region transcribed in the same direction as if in an operon. The genes have also been found in pairs within organisms. This pairing includes a protein fusion between OleB and OleC (herein referred to as OleBC). For example, the oleBC gene fusion has been observed in seven of the 67 organisms described above: *Arthrobacter aurescens*, both *Clavibacter michiganensis* species, *Kineococcus radiotolerans*, *Brevibacterium linens*, *Congregibacter litoralis*, and *Micrococcus luteus*.

Identifying an organism that contains one or more of the ole gene(s) would indicate that the organism also produces hydrocarbons naturally. Bioinformatic techniques were used to identify other sequenced organisms that contain genes that belong to these gene families (see, e.g., Tables 1 and 2). These genes can be used to confer hydrocarbon production on their host organism, as well as on other hosts when expressed in other host organisms. One of ordinary skill in the art will appreciate that additional oleA, oleB, oleC, oleD, and oleBC sequences can readily be cloned and used to make hydrocarbons and hydrocarbon intermediates. An exemplary list of OleA, OleB, OleC, OleD, and OleBC proteins identified using the methods disclosed herein can be found in Tables 1 and 2. A person having ordinary skill in the art would be able to identify or deduce the gene sequences from the OleA, OleB, OleC, OleD, and OleBC protein sequences set forth in Tables 1 and 2.

The invention is directed to an isolated nucleic acid encoding a polypeptide comprising, consisting essentially of, or consisting of, an amino acid sequence selected from the group consisting of (a) an OleA, OleB, OleC, OleD, or OleBC amino acid sequence; (b) a homolog of an OleA, OleB, OleC, OleD, or OleBC amino acid sequence; (c) a conservative variant of an OleA, OleB, OleC, OleD, or OleBC amino acid sequence comprising one or more conserved amino acid substitutions; and (d) an amino acid sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with an OleA, OleB, OleC, OleD, or OleBC amino acid sequence.

For example, the isolated nucleic acid can encode a polypeptide comprising, consisting essentially of, or consisting of, an amino acid sequence selected from the group consisting of (a) SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487; (b) a homolog of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487; (c) a conservative variant of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487 comprising one or more conserved amino acid substitutions; and (d) a sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487.

The isolated nucleic acid can encode a polypeptide comprising, consisting essentially of, or consisting of, an OleA, OleB, OleC, OleD, or OleBC amino acid sequence. For example, the isolated nucleic acid can encode a polypeptide comprising, consisting essentially of, or consisting of, an amino acid sequence selected from the group consisting of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487. Preferably, the isolated nucleic acid encodes a polypeptide comprising, consisting essentially of, or consisting of, an amino acid sequence selected from the group consisting of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, and SEQ ID NO: 88.

The isolated nucleic acid can encode a polypeptide comprising, consisting essentially of, or consisting of, an OleA amino acid sequence. For example, the isolated nucleic acid can encode a polypeptide comprising, consisting essentially of, or consisting of, an amino acid sequence selected from the group consisting of SEQ ID NO: 2, SEQ ID NO: 4, SEQ ID NO: 12, SEQ ID NO: 18, and SEQ ID NOs: 150-229. Preferably, the isolated nucleic acid encodes a polypeptide comprising, consisting essentially of, or consisting of, an amino acid sequence selected from the group consisting of SEQ ID NO: 2, SEQ ID NO: 4, SEQ ID NO: 12, and SEQ ID NO: 18.

The isolated nucleic acid can encode a polypeptide comprising, consisting essentially of, or consisting of, an OleB amino acid sequence. For example, the isolated nucleic acid can encode a polypeptide comprising, consisting essentially of, or consisting of, an amino acid sequence selected from the group consisting of SEQ ID NO: 10 and SEQ ID NOs: 230-326. Preferably, the isolated nucleic acid encodes a polypeptide comprising, consisting essentially of, or consisting of, an amino acid sequence comprising, consisting essentially of, or consisting of, SEQ ID NO: 10.

The isolated nucleic acid can encode a polypeptide comprising, consisting essentially of, or consisting of, an OleC amino acid sequence. For example, the isolated nucleic acid can encode a polypeptide comprising, consisting essentially of, or consisting of, an amino acid sequence selected from the group consisting of SEQ ID NO: 6, SEQ ID NO: 14, SEQ ID NO: 20, SEQ ID NO: 88, and SEQ ID NOs: 327-402. Preferably, the isolated nucleic acid encodes a polypeptide comprising, consisting essentially of, or consisting of, an amino acid sequence selected from the group consisting of SEQ ID NO: 6, SEQ ID NO: 14, SEQ ID NO: 20, and SEQ ID NO: 88.

The isolated nucleic acid can encode a polypeptide comprising, consisting essentially of, or consisting of, an OleD amino acid sequence. For example, the isolated nucleic acid can encode a polypeptide comprising, consisting essentially of, or consisting of, an amino acid sequence selected from the group consisting of SEQ ID NO: 8, SEQ ID NO: 16, SEQ ID NO: 22, SEQ ID NOs: 142-149, and SEQ ID NOs: 403-464. Preferably, the isolated nucleic acid encodes a polypeptide comprising, consisting essentially of, or consisting of, an amino acid sequence selected from the group consisting of SEQ ID NO: 8, SEQ ID NO: 16, and SEQ ID NO: 22.

The isolated nucleic acid can encode a polypeptide comprising, consisting essentially of, or consisting of, an OleBC amino acid sequence. For example, the isolated nucleic acid can encode a polypeptide comprising, consisting essentially of, or consisting of, an amino acid sequence selected from the group consisting of SEQ ID NOs: 135-141.

The isolated nucleic acid can encode a polypeptide comprising, consisting essentially of, or consisting of, an amino acid sequence that is a homolog of an OleA, OleB, OleC, OleD, or OleBC amino acid sequence. For example, the isolated nucleic acid can encode a polypeptide comprising, consisting essentially of, or consisting of, an amino acid sequence selected from the group consisting of a homolog of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487. Preferably, the isolated nucleic acid encodes a polypeptide comprising, consisting essentially of, or consisting of, an amino acid sequence selected from the group consisting of a homolog of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, and SEQ ID NO: 88.

The isolated nucleic acid can encode a polypeptide comprising, consisting essentially of, or consisting of, an amino acid sequence that is a homolog of OleA. For example, the isolated nucleic acid can encode a polypeptide comprising, consisting essentially of, or consisting of, an amino acid sequence selected from the group consisting of a homolog of SEQ ID NO: 2, SEQ ID NO: 4, SEQ ID NO: 12, SEQ ID NO: 18, and SEQ ID NOs: 150-229. Preferably, the isolated nucleic acid encodes a polypeptide comprising, consisting essentially of, or consisting of, an amino acid sequence selected from the group consisting of a homolog of SEQ ID NO: 2, SEQ ID NO: 4, SEQ ID NO: 12, and SEQ ID NO: 18.

The isolated nucleic acid can encode a polypeptide comprising, consisting essentially of, or consisting of, an amino acid sequence that is a homolog of OleB. For example, the isolated nucleic acid can encode a polypeptide comprising, consisting essentially of, or consisting of, an amino acid sequence selected from the group consisting of a homolog of SEQ ID NO: 10 and SEQ ID NOs: 230-326. Preferably, the isolated nucleic acid encodes a polypeptide comprising, consisting essentially of, or consisting of, a homolog of SEQ ID NO: 10.

The isolated nucleic acid can encode a polypeptide comprising, consisting essentially of, or consisting of, an amino acid sequence that is a homolog of OleC. For example, the isolated nucleic acid can encode a polypeptide comprising, consisting essentially of, or consisting of, an amino acid sequence selected from the group consisting of a homolog of SEQ ID NO: 6, SEQ ID NO: 14, SEQ ID NO: 20, SEQ ID NO: 88, and SEQ ID NOs: 327-402. Preferably, the isolated nucleic acid encodes a polypeptide comprising, consisting essentially of, or consisting of, an amino acid sequence selected from the group consisting of a homolog of SEQ ID NO: 6, SEQ ID NO: 14, SEQ ID NO: 20, and SEQ ID NO: 88.

The isolated nucleic acid can encode a polypeptide comprising, consisting essentially of, or consisting of, an amino acid sequence that is a homolog of OleD. For example, the isolated nucleic acid can encode a polypeptide comprising, consisting essentially of, or consisting of, an amino acid sequence selected from the group consisting of a homolog of SEQ ID NO: 8, SEQ ID NO: 16, SEQ ID NO: 22, SEQ ID NOs: 142-149, and SEQ ID NOs: 403-464. Preferably, the isolated nucleic acid encodes a polypeptide comprising, consisting essentially of, or consisting of, an amino acid sequence selected from the group consisting of a homolog of SEQ ID NO: 8, SEQ ID NO: 16, and SEQ ID NO: 22

The isolated nucleic acid can encode a polypeptide comprising, consisting essentially of, or consisting of, an amino acid sequence that is a homolog of OleBC. For example, the isolated nucleic acid can encode a polypeptide comprising, consisting essentially of, or consisting of, an amino acid sequence selected from the group consisting of a homolog of SEQ ID NOs: 135-141.

A homolog of an OleA, OleB, OleC, OleD, or OleBC protein is one that functionally performs substantially like an OleA, OleB, OleC, OleD, or OleBC protein, for instance, in terms of having hydrocarbon synthase activity. For example, an OleA, OleB, OleC, OleD, or OleBC protein and an OleA, OleB, OleC, OleD, or OleBC protein homolog do not necessarily have similar amino acid sequences. However, they do have similar hydrocarbon synthase activities.

Calculations of "homology" between two sequences can be performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence that is aligned for comparison purposes is at least about 30%, preferably at least about 40%, more preferably at least about 50%, even more preferably at least about 60%, and even more preferably at least about 70%, at least about 80%, at least about 90%, or about 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps and the length of each gap, which need to be introduced for optimal alignment of the two sequences.

The isolated nucleic acid can encode a polypeptide comprising, consisting essentially of, or consisting of, an amino acid sequence that is a conservative variant of an OleA, OleB, OleC, OleD, or OleBC amino acid sequence. For example, the isolated nucleic acid can encode a polypeptide comprising, consisting essentially of, or consisting of, an amino acid sequence selected from the group consisting of a conservative variant of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487. Preferably, the isolated nucleic acid encodes a polypeptide comprising, consisting essentially of, or consisting of, an amino acid sequence selected from the group consisting of a conservative variant of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, and SEQ ID NO: 88.

The isolated nucleic acid can encode a polypeptide comprising, consisting essentially of, or consisting of, an amino acid sequence that is a conservative variant of an OleA amino acid sequence. For example, the isolated nucleic acid can encode a polypeptide comprising, consisting essentially of or consisting of an amino acid sequence selected from the group consisting of a conservative variant of SEQ ID NO: 2, SEQ ID NO: 4, SEQ ID NO: 12, SEQ ID NO: 18, and SEQ ID NOs: 150-229. Preferably, the isolated nucleic acid encodes a polypeptide comprising, consisting essentially of, or consisting of, an amino acid sequence selected from the group consisting of a conservative variant of SEQ ID NO: 2, SEQ ID NO: 4, SEQ ID NO: 12, and SEQ ID NO: 18.

The isolated nucleic acid can encode a polypeptide comprising, consisting essentially of, or consisting of, an amino acid sequence that is a conservative variant of an OleB amino acid sequence. For example, the isolated nucleic acid can encode a polypeptide comprising, consisting essentially of, or consisting of, an amino acid sequence selected from the group consisting of a conservative variant of SEQ ID NO: 10 and SEQ ID NOs: 230-326. Preferably, the isolated nucleic acid encodes a polypeptide comprising, consisting essentially of, or consisting of, an amino acid sequence that is a conservative variant of SEQ ID NO: 10.

The isolated nucleic acid can encode a polypeptide comprising, consisting essentially of, or consisting of, an amino acid sequence that is a conservative variant of an OleC amino acid sequence. For example, the isolated nucleic acid can encode a polypeptide comprising, consisting essentially of, or consisting of, an amino acid sequence selected from the group consisting of a conservative variant of SEQ ID NO: 6, SEQ ID NO: 14, SEQ ID NO: 20, SEQ ID NO: 88, and SEQ ID NOs: 327-402. Preferably, the isolated nucleic acid encodes a polypeptide comprising, consisting essentially of, or consisting of, an amino acid sequence selected from the group consisting of a conservative variant of SEQ ID NO: 6, SEQ ID NO: 14, SEQ ID NO: 20, and SEQ ID NO: 88.

The isolated nucleic acid can encode a polypeptide comprising, consisting essentially of, or consisting of, an amino acid sequence that is a conservative variant of an OleD amino acid sequence. For example, the isolated nucleic acid can encode a polypeptide comprising, consisting essentially of, or consisting of, an amino acid sequence selected from the group consisting of a conservative variant of SEQ ID NO: 8, SEQ ID NO: 16, SEQ ID NO: 22, SEQ ID NOs: 142-149, and SEQ ID NOs: 403-464. Preferably, the isolated nucleic acid encodes a polypeptide comprising, consisting essentially of, or consisting of, an amino acid sequence selected from the group consisting of a conservative variant of SEQ ID NO: 8, SEQ ID NO: 16, and SEQ ID NO: 22.

The isolated nucleic acid can encode a polypeptide comprising, consisting essentially of, or consisting of, an amino acid sequence that is a conservative variant of an OleBC amino acid sequence. For example, the isolated nucleic acid can encode a polypeptide comprising, consisting essentially of, or consisting of, an amino acid sequence selected from the group consisting of a conservative variant of SEQ ID NOs: 135-141.

As used herein, a "variant" of polypeptide X refers to a polypeptide having the amino acid sequence of peptide X in which one or more amino acid residues is altered. The variant may have conservative changes or nonconservative changes. Guidance in determining which amino acid residues may be substituted, inserted, or deleted without affecting biological activity may be found using computer programs well known in the art, for example, LASERGENE software (DNASTAR).

The term "variant," when used in the context of a polynucleotide sequence, may encompass a polynucleotide sequence related to that of a gene or the coding sequence thereof. This definition may also include, for example, "allelic," "splice," "species," or "polymorphic" variants. A splice variant may have significant identity to a reference polynucleotide, but will generally have a greater or lesser number of polynucleotides due to alternative splicing of exons during mRNA processing. The corresponding polypeptide may possess additional functional domains or an absence of domains. Species variants are polynucleotide sequences that vary from one species to another. The resulting polypeptides generally will have significant amino acid identity relative to each other. A polymorphic variant is a variation in the polynucleotide sequence of a particular gene between individuals of a given species.

Conserved amino acid substitutions can be any amino acid substitution shown in Table 13. Specifically, conserved amino acid substitutions can be selected from the group consisting of alanine to D-Ala, Gly, beta-Ala, L-Cys, D-Cys; arginine to D-Arg, Lys, D-Lys, homo-Arg, D-homo-Arg, Met, Ile, D-Met, D-Ile, Orn, D-Orn; asparagine to D-Asn, Asp, D-Asp, Glu, D-Glu, Gln, D-Gln; aspartic acid to D-Asp, D-Asn, Asn, Glu, D-Glu, Gln, D-Gln; cysteine to D-Cys, S-Me-Cys, Met, D-Met, Thr, D-Thr; glutamic acid to D-Glu, D-Asp, Asp, Asn, D-Asn, Gln, D-Gln; glycine to Ala, D-Ala, Pro, D-Pro, b-Ala, Acp; isoleucine to D-Ile, Val, D-Val, Leu, D-Leu, Met, D-Met; leucine to D-Leu, Val, D-Val, Leu, D-Leu, Met, D-Met; lysine to D-Lys, Arg, D-Arg, homo-Arg, D-homo-Arg, Met, D-Met, Ile, D-Ile, Urn, D-Urn; methionine to D-Met, S-Me-Cys, Ile, D-Ile, Leu, D-Leu, Val, D-Val; phenylalanine to D-Phe, Tyr, D-Thr, L-Dopa, His, D-His, Trp, D-Trp, Trans-3, 4, or 5-phenylproline, cis-3, 4, or 5-phenylproline; proline to D-Pro, L-1-thioazolidine-4-carboxylic acid, D- or L-1-oxazolidine-4-carboxylic acid; serine to D-Ser, Thr, D-Thr, allo-Thr, Met, D-Met, Met(O), D-Met(O), L-Cys, D-Cys; threonine to D-Thr, Ser, D-Ser, allo-Thr, Met, D-Met, Met(O), D-Met(O), Val, D-Val; tyrosine to D-Tyr, Phe, D-Phe, L-Dopa, His, D-His; and valine to D-Val, Leu, D-Leu, Ile, D-Ile, Met, D-Met.

TABLE 13

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, Ile, D-Met, D-Ile, Orn, D-Orn |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamic Acid | E | D-Glu, D-Asp, Asp, Asn, D-Asn, Gln, D-Gln |
| Glycine | G | Ala, D-Ala, Pro, D-Pro, b-Ala, Acp |
| Isoleucine | I | D-Ile, Val, D-Val, Leu, D-Leu, Met, D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, D-Met, Ile, D-Ile, Orn, D-Orn |
| Methionine | M | D-Met, S-Me-Cys, Ile, D-Ile, Leu, D-Leu, Val, D-Val |
| Phenylalanine | F | D-Phe, Tyr, D-Thr, L-Dopa, His, D-His, Trp, D-Trp, Trans-3, 4, or 5-phenylproline, cis-3, 4, or 5-phenylproline |
| Proline | P | D-Pro, L-1-thioazolidine-4-carboxylic acid, D-or L-1-oxazolidine-4-carboxylic acid |
| Serine | S | D-Ser, Thr, D-Thr, allo-Thr, Met, D-Met, Met(O), D-Met(O), L-Cys, D-Cys |
| Threonine | T | D-Thr, Ser, D-Ser, allo-Thr, Met, D-Met, Met(O), D-Met(O), Val, D-Val |
| Tyrosine | Y | D-Tyr, Phe, D-Phe, L-Dopa, His, D-His |
| Valine | V | D-Val, Leu, D-Leu, Ile, D-Ile, Met, D-Met |

A conservative variant of an Ole protein can comprise one or more conserved amino acid substitutions. For example, a conservative variant can have about 1, 2, 3, 4, 5, 6, 7, 8, 9, 10, 15, 20, 25, 30, 35, 40, or 50 conserved amino acid substitutions. In a preferred embodiment, a conservative variant has no more than about 50 conserved amino acid substitutions. For example, a conservative variant can have no more than about 3, 5, 10, 15, 20, 25, 30, 35, 40, or 50 conserved amino acid substitutions. A conservative variant of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487 is one that functionally performs substantially like the respective amino acid sequence without the amino acid substitutions. Any one of the assays provided herein can be used to assess activity. In some examples, a conservative variant of an OleA protein can be assayed for hydrocarbon synthase activity, such as acyl condensing activity, aliphatic ketone synthase activity, and/or olefin synthase activity. As used herein, the term "synthase" refers to an enzyme which catalyzes a synthesis process. As used herein, the term synthase includes synthases, synthetases, and ligases.

In other examples, conservative variants of OleC and OleD can be assayed for activity as described herein. The conservative variant can have, for instance, about one conserved amino acid substitution, two amino acid substitutions, three amino acid substitutions, four amino acid substitutions, or five or more amino acid substitutions in an amino acid sequence, as long as activity of the protein is maintained.

Preferably, the isolated nucleic acid encodes a polypeptide comprising, consisting essentially of, or consisting of, an amino acid sequence selected from the group consisting of a conservative variant of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, and SEQ ID NO: 88 comprising one or more conserved amino acid substitutions selected from the group consisting of Ala to Cys, Gly, or Ser; Arg to Ile, Lys, Met, or Orn; Asn to Asp, Gln, Glu, or His; Asp to Asn, Gln, or Glu; Cys to Met, Ser, or Thr; Gln to Asn, Asp, or Glu; Glu to Asn, Asp, or Gln; Gly to Acp, Ala, or Pro; His to Asn or Gln; Ile to Leu, Met, or Val; Leu to Ile, Met, or Val; Lys to Arg, Gln, Glu, Ile, Met or Orn; Met to Cys, Ile, Leu, or Val; Phe to His, L-Dopa, Leu, Met, Thr, Trp, Tyr, 3-phenylproline, 4-phenylproline, or 5-phenylproline; Pro to L-1-thioazolidine-4-carboxylic acid or D- or L-1-oxazolidine-4-carboxylic acid; Ser to Cys, Met, or Thr; Thr to Met, Ser, or Val; Trp to Tyr; Tyr to L-Dopa, His, or Phe; and Val to Ile, Leu, or Met.

In some embodiments, a conservative variant includes one or more conservative amino acid substitutions compared to the sequence from which it was derived, and yet retains its respective activity. For example, a conservative variant can retain at least about 10% of the biological activity of the parent protein from which it was derived, or alternatively, at least about 20%, at least about 30%, or at least about 40% of the biological activity of the parent protein. In some preferred embodiments, a conservative variant retains at least about 50% of the biological activity of the parent protein from which it was derived. The conservative amino acid substitutions of a conservative variant can occur in any domain of the protein. In another embodiment, the conserved amino acid substitutions may result in enhanced biological activity when compared to the parent protein. For example, the conservative variant may have a biological activity of at least about 100% of the biological activity of the parent protein from which it was derived, or alternatively, at least about 110%, at least about 120%, at least about 150%, at least about 200%, or at least about 1000% of the biological activity of the parent protein from which it was derived.

The isolated nucleic acid can encode a polypeptide comprising, consisting essentially of, or consisting of, an amino acid sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with OleA, OleB, OleC, OleD, or OleBC. The isolated nucleic acid can encode a polypeptide comprising, consisting essentially of, or consisting of an amino acid sequence selected from the group consisting of a sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487. Preferably, the isolated nucleic acid encodes a polypeptide comprising, consisting essentially of, or consisting of, an amino acid sequence selected from the group consisting of a sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, and SEQ ID NO: 88.

The isolated nucleic acid can encode a polypeptide comprising, consisting essentially of, or consisting of, an amino acid sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with OleA. The isolated nucleic acid can encode a polypeptide comprising, consisting essentially of, or consisting of, an amino acid sequence selected from the group consisting of a sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with SEQ ID NO: 2, SEQ ID NO: 4, SEQ ID NO: 12, SEQ ID NO: 18, and SEQ ID NOs: 150-229.

The isolated nucleic acid can encode a polypeptide comprising, consisting essentially of, or consisting of, an amino acid sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with OleB. The isolated nucleic acid can encode a polypeptide comprising, consisting essentially of, or consisting of, an amino acid sequence selected from the group consisting of a sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with SEQ ID NO: 10 and SEQ ID NOs: 230-326.

The isolated nucleic acid can encode a polypeptide comprising, consisting essentially of, or consisting of, an amino acid sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with OleC. The isolated nucleic acid can encode a polypeptide comprising, consisting essentially of, or consisting of, an amino acid sequence selected from the group consisting of a sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with SEQ ID NO: 6, SEQ ID NO: 14, SEQ ID NO: 20, SEQ ID NO: 88, and SEQ ID NOs: 327-402.

The isolated nucleic acid can encode a polypeptide comprising, consisting essentially of, or consisting of, an amino acid sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) identity with OleD. The isolated nucleic acid can encode a polypeptide comprising, consisting essentially of, or consisting of, an amino acid sequence selected from the group consisting of a sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with SEQ ID NO: 8, SEQ ID NO: 16, SEQ ID NO: 22, SEQ ID NOs: 142-149, and SEQ ID NOs: 403-464.

The isolated nucleic acid can encode a polypeptide comprising, consisting essentially of, or consisting of, an amino acid sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with OleBC. The isolated nucleic acid can encode a polypeptide comprising, consisting essentially of, or consisting of, an amino acid sequence selected from the group consisting of a sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with SEQ ID NOs: 135-141.

An isolated nucleic acid encoding a polypeptide comprising, consisting essentially of, or consisting of, an amino acid sequence having between about 35% and about 100% sequence identity with an amino acid sequence encoding an Ole protein is also provided herein. For example, the isolated nucleic acid can encode a polypeptide comprising, consisting essentially of, or consisting of, an amino acid sequence having at least about 35%, at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5% sequence identity with an amino acid sequence encoding an Ole protein.

Although particular embodiments of hydrocarbon and hydrocarbon intermediate forming nucleic acid and amino acid sequences are disclosed, it will be understood that sequences that have similar structural characteristics can be isolated from other organisms. These newly isolated sequences can be assayed for hydrocarbon synthase activity (see Tables 1 and 2 for a list of specific, non-limiting examples of related sequences). In addition, it will be understood that other functionally equivalent forms of the nucleic acid and amino acid sequences disclosed herein can be readily identified and/or generated using conventional molecular biological techniques, including, for instance, site-directed mutagenesis, M13 primer mutagenesis, error prone PCR, sexual PCR, DNA synthesis, or DNA shuffling. Details of many of these techniques are provided in Sambrook et al., *Molecular Cloning: A Laboratory Manual*, 3rd ed., vol. 1-3, Cold Spring Harbor, N.Y. (2000).

Thus, in addition to structurally related sequences and homologous sequences, the invention also encompasses amino acid sequences that have at least about 30%, 35%, 40%, 45%, 50%, 55%, 60%, 65%, 70%, 75%, 80%, 85%, 90%, or 95% sequence identity with SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, and/or SEQ ID NOs: 135-464. In further embodiments the invention encompasses amino acid sequences that have at least about 96%, 97%, 98%, 99%, or 99.5% sequence identity with SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, and/or SEQ ID NOs: 135-464.

Sequences retaining structural and functional similarity to OleA, OleB, OleC, OleBC, and OleD can be identified by any number of known methods. One such method involves the screening of genomic sequences for sequence alignment with the known sequence(s). Methods for aligning sequences for comparison are well known in the art. Various programs and alignment algorithms are described in: Smith et al., *Adv. Appl. Math.*, 2: 482 (1981); Needleman et al., *J. Mol. Biol.*, 48: 443 (1970); Pearson et al., *Proc. Natl. Acad. Sci. USA*, 85: 2444 (1988); Higgins et al., *Gene*, 73: 237-244 (1988); Higgins & Sharp, *CABIOS*, 5: 151-153 (1989); Corpet et al., *Nucleic Acids Research*, 16: 10881-10890 (1988); Huang et al., *CABIOS*, 8: 155-165 (1992); and Pearson et al., *Methods in Molecular Biology*, 24: 307-331 (1994). Altschul et al., *J. Mol. Biol.*, 215: 403-410 (1990), presents a detailed description of sequence alignment methods and homology calculations.

In a preferred embodiment, the percent homology between two amino acid sequences is determined using the Needleman, supra, algorithm that has been incorporated into the GAP program in the GCG software package, using either a BLOSUM62 matrix or a PAM250 matrix, and a gap weight of 16, 14, 12, 10, 8, 6, or 4 and a length weight of 1, 2, 3, 4, 5, or 6. In yet another preferred embodiment, the percent homology between two nucleotide sequences is determined using the GAP program in the GCG software package, using a NWSgapdna.CMP matrix and a gap weight of 40, 50, 60, 70, or 80 and a length weight of 1, 2, 3, 4, 5, or 6. A particularly preferred set of parameters (and the one that should be used if the practitioner is uncertain about which parameters should be applied to determine if a molecule is within a homology limitation of the claims) are a BLOSUM62 scoring matrix with a gap penalty of 12, a gap extend penalty of 4, and a frameshift gap penalty of 5.

The invention also provides an isolated nucleic acid encoding more than one polypeptide, wherein each polypeptide comprises, consists essentially of, or consists of an amino acid sequence selected from the group consisting of (a) an OleA, OleB, OleC, OleD, or OleBC amino acid sequence; (b) a homolog of an OleA, OleB, OleC, OleD, or OleBC amino acid sequence; (c) a conservative variant of an OleA, OleB, OleC, OleD, or OleBC amino acid sequence comprising one or more conserved amino acid substitutions; and (d) an amino acid sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with an OleA, OleB, OleC, OleD, or OleBC amino acid sequence. The isolated nucleic acid can encode a first polypeptide and a second polypeptide, wherein each of the first and second polypeptides comprises, consists essentially of, or consists of an amino acid sequence selected from the group consisting of (a) an OleA, OleB, OleC, OleD, or OleBC amino acid sequence; (b) a homolog of an OleA, OleB, OleC, OleD, or OleBC amino acid sequence; (c) a conservative variant of an OleA, OleB, OleC, OleD, or OleBC amino acid sequence comprising one or more conserved amino acid substitutions; and (d) an amino acid sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with an OleA, OleB, OleC, OleD, or OleBC amino acid sequence. For example, the isolated nucleic acid can encode a first polypeptide and a second polypeptide, wherein each of the first and second polypeptides comprises, consists essentially of, or consists of an amino acid sequence selected from the group consisting of (a) SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487; (b) SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487; (c) a conservative variant of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487 comprising one or more conserved amino acid substitutions; and (d) a sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487.

The isolated nucleic acid can encode a first polypeptide, a second polypeptide, and a third polypeptide, wherein each of the first, second, and third polypeptides comprises, consists essentially of, or consists of an amino acid sequence selected from the group consisting of (a) an OleA, OleB, OleC, OleD, or OleBC amino acid sequence; (b) a homolog of an OleA, OleB, OleC, OleD, or OleBC amino acid sequence; (c) a conservative variant of an OleA, OleB, OleC, OleD, or OleBC amino acid sequence comprising one or more conserved amino acid substitutions; and (d) an amino acid sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with an OleA, OleB, OleC, OleD, or OleBC amino acid sequence. For example, the isolated nucleic acid can encode a first polypeptide, a second polypeptide, and a third polypeptide, wherein each of the first, second, and third polypeptides comprises, consists essentially of, or consists of an amino acid sequence selected from the group consisting of (a) SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487; (b) SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487; (c) a conservative variant of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487 comprising one or more conserved amino acid substitutions; and (d) a sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487.

The isolated nucleic acid can encode a first polypeptide, a second polypeptide, a third polypeptide, and a fourth polypeptide, wherein each of the first, second, third, and fourth polypeptides comprises, consists essentially of, or consists of an amino acid sequence selected from the group consisting of (a) an OleA, OleB, OleC, OleD, or OleBC amino acid sequence; (b) a homolog of an OleA, OleB, OleC, OleD, or OleBC amino acid sequence; (c) a conservative variant of an OleA, OleB, OleC, OleD, or OleBC amino acid sequence comprising one or more conserved amino acid substitutions; and (d) an amino acid sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with an OleA, OleB, OleC, OleD, or OleBC amino acid sequence. For example, the isolated nucleic acid can encode a first polypeptide, a second polypeptide, a third polypeptide, and a fourth polypeptide, wherein each of the first, second, third, and fourth polypeptides comprises, consists essentially of, or consists of an amino acid sequence selected from the group consisting of (a) SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487; (b) SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487; (c) a conservative variant of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487 comprising one or more conserved amino acid substitutions; and (d) a sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487.

The isolated nucleic acid can encode a polypeptide having about 1500 amino acid residues, about 1400 amino acid residues, about 1300 amino acid residues, about 1200 amino acid residues, about 1100 amino acid residues, about 1000 amino acid residues, about 900 amino acid residues, about 800 amino acid residues, about 700 amino acid residues, about 600 amino acid residues, about 500 amino acid residues, about 400 amino acid residues, or about 300 amino acid residues. In a preferred embodiment, the isolated nucleic acid encodes a polypeptide having no more than about 1500 (e.g., no more than about 1500, 1400, 1300, 1200, 1100, 1000, 900, 800, 700, 600, 500, 400, 300, or 200) amino acid residues.

The isolated nucleic acid can encode a polypeptide having at least about 100 amino acid residues. For example, the isolated nucleic acid can encode a polypeptide having at least about 200 amino acid residues, at least about 250 amino acid residues, or at least about 300 amino acid residues. Alternatively, the isolated nucleic acid can encode a polypeptide having no less than 100 (e.g., no less than 100, 150, 200, or 250) amino acid residues. The isolated nucleic acid can encode a polypeptide having between about 200 amino acid residues and about 1500 amino acid residues, between about 300 amino acid residues and about 1000 amino acid residues, between about 500 amino acid residues and about 800 amino acid residues, or between about 600 amino acid residues and about 1000 amino acid residues.

The isolated nucleic acid can be isolated from a bacterium, a plant, an insect, a yeast, a fungus, or a animal (e.g., a mammal). When the nucleic acid is isolated from a bacterium, the bacterium can be any genus of bacteria. For example, the bacterium can be of a genus selected from the group consisting of *Anaeromyxobacter, Arthrobacter, Bdellovibrio, Blastopirellula, Brevibacterium, Burkholderia, Candidatus, Chloroflexus, Clavibacter, Clostridium, Colwellia, Congregibacter, Desulfatibacillum, Desulfococcus, Desulfotalea, Desulfuromonas, Flavobacteriales, Gemmata, Geobacter, Hahella, Jannaschia, Kineococcus, Lentisphaera, Maricaulis, Marinobacter, Micrococcus, Microscilla, Moritella, Mycobacterium, Neisseria, Nocardia, Opitutaceae, Opitutus, Paenibacillus, Pelobacter, Photobacterium, Photorhabdus, Planctomyces, Plesiocystis, Pseudoalteromonas, Psychromonas, Ralstonia, Rhodococcus, Rhodopirellula, Roseovarius, Shewanella, Stenotrophomonas, Streptomyces, Xanthomonas*, and *Xylella*.

More specifically, the nucleic acid can be isolated from any bacterium selected from the group consisting of *Anaeromyxobacter, Arthrobacter aurescens, Arthrobacter chlorophenolicus, Arthrobacter* sp. FB24, *Bdellovibrio bacteriovorus, Blastopirellula marina, Brevibacterium linens, Burkholderia ambifaria, Burkholderia cenocepacia, Burkholderia oklahomensis, Burkholderia pseudomallei, Burkholderia* sp. 383, *Candidatus Kuenenia stuttgartiensis, Chloroflexus aggregans, Chloroflexus aurantiacus, Clavibacter michiganensis* subsp. *michiganensis, Clavibacter michiganensis* subsp. *Sepedonicus, Clostridium botulinum, Colwellia psychrerythraea, Congregibacter litoralis, Desulfatibacillum alkenivorans, Desulfococcus oleovorans, Desulfotalea psychrophila, Desulfuromonas acetoxidans, Flavobacteriales bacterium, Gemmata obscuriglobus, Geobacter bemidjiensis, Geobacter lovleyi, Geobacter* sp. FRC-32, *Geobacter uraniumreducens, Hahella chejuensis, Jannaschia* sp. CCS1, *Kineococcus radiotolerans, Lentisphaera araneosa, Maricaulis marls, Marinobacter algicola, Marinobacter aquaeolei, Micrococcus luteus, Microscilla marina, Moritella* sp. PE36, *Mycobacterium avium, Mycobacterium marinum, Mycobacterium* sp. GP1, *Mycobacterium tuberculosis, Mycobacterium vanbaalenii, Neisseria gonorrhoeae, Nocardia farcinica, Opitutaceae bacterium, Opitutus terrae, Paenibacillus* sp. JDR-2, *Pelobacter propionicus, Photobacterium profundum, Photobacterium profundum, Photorhabdus luminescens, Planctomyces mails, Plesiocystis pacifica, Pseudoalteromonas atlantica, Psychromonas ingrahamii, Psychromonas* sp. CNPT3, *Ralstonia pickettii, Rhodococcus rhodochrous, Rhodococcus* sp., *Rhodopirellula baltica, Roseovarius nubinhibens* ISM, *Shewanella amazonensis* SB2B, *Shewanella baltica* OS155, *Shewanella baltica, Shewanella benthica, Shewanella denitrificans, Shewanella frigidimarina, Shewanella halifaxensis, Shewanella loihica, Shewanella oneidensis, Shewanella pealeana, Shewanella putrefaciens, Shewanella sediminis, Shewanella* sp. ANA-3, *Shewanella* sp. MR-4, *Shewanella* sp. MR-7, *Shewanella* sp. W3-18-1, *Shewanella woodyi, Stenotrophomonas maltophilia, Streptomyces ambofaciens, Xanthomonas axonopodis, Xanthomonas campestris, Xanthomonas oryzae*, and *Xylella fastidiosa*. In a preferred embodiment, the nucleic acid is isolated from a strain of *Stenotrophomonas maltophilia* (e.g., *Stenotrophomonas maltophilia* ATCC 17679, *Stenotrophomonas maltophilia* ATCC 17674, *Stenotrophomonas maltophilia* ATCC 17445, *Stenotrophomonas maltophilia* ATCC 17666, *Stenotrophomonas maltophilia* K279a, or *Stenotrophomonas maltophilia* R551-3).

When a genomic sequence is not available for a particular species of interest, related sequences can be amplified from genomic DNA using standard PCR methods. Briefly, genomic DNA is extracted from the cells of interest by any one of a variety of well known methods. Sambrook et al., supra, and Ausubel et al., *Current Protocols in Molecular Biology*, Greene Publ. Assoc. & Wiley-Intersciences (1989), provide descriptions of methods for DNA isolation. Generally, any organism can be used as a source of such DNA. The extracted DNA is then used as a template for performing a polymerase chain reaction. Degenerate primers may need to be used for PCR. Methods and conditions for PCR are described, for example, in PCR Protocols, A Guide to Methods and Applications, Innis et al. (eds.), Academic Press, Inc., San Diego, Calif., 1990.

The selection of amplification primers will be made according to the particular gene that is to be amplified. Specific examples of primers of use are shown in Table 14, below. However, these primers are illustrative only. One of ordinary skill in the art will appreciate that many different primers can be derived from the oleA, oleB, oleC, oleBC, and oleD nucleic acid sequences. Variations in amplification conditions can be required to accommodate primers and amplicons of differing lengths and composition. Such considerations are well known in the art and are discussed, for instance, in PCR Protocols, A Guide to Methods and Applications, Innis et al. (eds.), Academic Press, Inc., San Diego, Calif., 1990.

Sequencing of PCR products obtained by these amplification procedures can be used to facilitate confirmation of the amplified sequence and provide information about natural variation of this sequence in different species. Oligonucleotides derived from the provided OleA, OleB, OleC, OleBC and OleD sequences can be used in such sequencing methods. Closely related orthologous OleA, OleB, OleC, OleBC and OleD sequences can share at least about 30%, 35%, 40%, 45%, 50%, 55%, 60%, 65%, 70%, 75%, 80%, 85%, 90%, 95%, 98%, 99%, or 99.5% sequence identity with the disclosed OleA, OleB, OleC, OleBC and OleD sequences (see, e.g., Tables 1 and 2).

In a preferred embodiment, the nucleic acid is selected from the group consisting of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, and SEQ ID NO: 87.

Also disclosed herein are recombinant nucleic acid constructs that include one or more isolated nucleic acids encoding Ole proteins, homologs of Ole proteins, conservative variants of Ole proteins, and/or sequences having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with Ole proteins. Exemplary recombinant nucleic acid constructs include cloning vectors, expression vectors, or synthetic operons.

As used herein, the term "vector" refers to a nucleic acid molecule capable of transporting another nucleic acid to which it has been linked. One type of useful vector is an episome (i.e., a nucleic acid capable of extra-chromosomal replication). Useful vectors are those capable of autonomous replication and/or expression of nucleic acids to which they are linked. Vectors capable of directing the expression of genes to which they are operatively linked are referred to herein as "expression vectors". In general, expression vectors of utility in recombinant DNA techniques are often in the form of "plasmids," which refer generally to circular double stranded DNA loops that, in their vector form, are not bound to the chromosome. As used herein, "plasmid" and "vector" are used interchangeably, as the plasmid is the most commonly used form of vector. However, also included are such other forms of expression vectors that serve equivalent functions and that become known in the art subsequently hereto.

Both cloning and expression vectors contain nucleotide sequences that allow the vectors to replicate in one or more suitable recombinant organisms. In cloning vectors, this sequence is generally one that enables the vector to replicate independently of the recombinant organism chromosomes and also includes either origins of replication or autonomously replicating sequences. Various bacterial and viral origins of replication are well known and include, but are not limited to, pBR322 derived ColE1 replicon, the P15A replicon, the pCloDF13 replicon, the pKN402 replicon, the pMB1 (pUC) replicon, the pSC101 replicon, and the SV40, polyoma, adenovirus, VSV and BPV viral origins.

The nucleic acids disclosed herein can be used to produce proteins by the use of recombinant expression vectors comprising an isolated nucleic acid. A wide variety of expression vectors can be used. For example, plasmids, chromosomal, episomal and virus-derived vectors, including vectors derived from bacterial plasmids, bacteriophages, yeast episomes, yeast chromosomal elements, viruses, such as baculoviruses, papoviruses, such as SV40, vaccinia viruses, adenoviruses, fowl pox viruses, pseudorabies viruses and retroviruses, and vectors derived from combinations thereof, such as those derived from plasmid and bacteriophage genetic elements, such as cosmids and phagemids.

Generally, any vector suitable to maintain, propagate, or express polynucleotides to express a polypeptide in a recombinant organism can be used for expression in this regard. Therefore, any other vector that is replicable and viable in the recombinant organism can be used. Non-limiting examples of bacterial expression vectors include pKK223-3 and pTrc 99A, which carry the trp-lac promoter; pUC, pTZ, pSK, and pGEM, which carry the lac promoter; the pET vector and derivatives thereof, which contain the T7 promoter; and the pHUB series of vectors, the pPLc series of vectors, pKC30, pAS1, pRM1/pRM9, and pTrxFus, all of which contain the bacteriophage λ $p_L$ promoter. Additional exemplary vectors include the pATH series of vectors, the pBAD series of vectors, the pBEc series of vectors, the pCAL series of vectors, the pCRT7 series of vectors, pGAL, pGEX, and derivatives, the pLEX series of vectors, the pMAL series of vectors, the pOSEX series of vectors, the pQE series of vectors, the pRSET series of vectors, and the pTriEx series of vectors. Vectors suitable for expression of the nucleic acid in *S. cerevisiae* include, for example, pAD-GAL4 and derivatives thereof, pBridge, pCM and derivatives thereof, the pEMBLY series of vectors, pESC and derivatives thereof, the pFL series of vectors, pSZ62, the pYC2 and pYC6 series of vectors, and the YIP series of plasmids.

The appropriate nucleic acid sequence is inserted into the vector by any of a variety of well-known and routine techniques. In general, a nucleic acid sequence for expression is joined to an expression vector by cleaving the nucleic acid sequence and the expression vector with one or more restriction endonucleases and then joining the restriction fragments together using a T4-DNA ligase. Procedures for restriction and ligation are well known in the art. Suitable procedures in this regard and for constructing expression vectors using alternative techniques, which also are well known in the art, are set forth in great detail in Sambrook et al., supra. Non-limiting examples of these alternative techniques include, for example, incorporation of the nucleic acid sequence by recombinase or topoisomerase.

Nucleic acid sequences can be modified or linked together by conventional techniques such as SOE PCR, DNA synthesis, blunt end ligation, or ligation at restriction enzyme sites. If suitable restriction sites are not available, then synthetic oligonucleotide adapters or linkers can be used (see, e.g., Sambrook et al., supra; Ausubel et al., supra).

One of ordinary skill in the art will recognize that numerous promoters are functional in cells and have been described in the literature, including constitutive, inducible, developmentally regulated, and environmentally regulated promoters. Of particular interest is the use of promoters (also referred to as transcriptional initiation regions) that are functional in the appropriate recombinant organism. For example, if *E. coli* is used as a recombinant organism, then exemplary promoters that can be used include, but are not limited to, the phage lambda PL promoter, the *E. coli* lac, trp, trc, and tac promoters, the SV40 early and late promoters, promoters of retroviral LTRs, and the CaMV 35S promoter. If *Saccharomyces cerevisiae* is the host, then the sequences of interest are typically under the control of yeast promoters. A non-limiting, example of a useful yeast promoter includes the GAL/CYC promoter.

Any suitable promoter known to a person of ordinary skill in the art which is not mentioned herein can be readily employed in the invention described herein. For example, other promoters known to control the expression of genes in prokaryotic or eukaryotic cells can be used. Expression vectors can also contain a ribosome binding site for translation initiation and a transcription termination site. The vector can also contain sequences useful for the amplification of gene expression.

The invention provides an isolated nucleic acid comprising a promoter operably linked to a nucleic acid encoding the polypeptide. Preferably, the promoter is an inducible promoter, a constitutive promoter, or a cell-specific promoter. In a preferred embodiment, the promoter is a T7 promoter. In another preferred embodiment, the promoter is a pTrc promoter, a PxylA promoter, a Pgrac promoter, a GAL1 promoter, or a GAL10 promoter.

As used herein, the term "operably linked" means that selected nucleotide sequence (e.g., encoding a polypeptide described herein) is in proximity with a promoter to allow the promoter to regulate expression of the selected DNA. In addition, the promoter is located upstream of the selected nucleotide sequence in terms of the direction of transcription and translation. By "operably linked" is meant that a nucleotide sequence and a regulatory sequence(s) are connected in such a way as to permit gene expression when the appropriate molecules (e.g., transcriptional activator proteins) are bound to the regulatory sequence(s).

Regulatory transcript termination regions can be provided in expression constructs as well. Transcript termination regions can be provided by the vector sequence that encodes the Ole protein sequences or a transcript termination region which is naturally associated with the transcript initiation region can be used. Any convenient transcript termination region that is capable of terminating transcription in a recombinant organism can be employed in the constructs disclosed herein. Expression and cloning vectors can, and usually do, contain a structural gene or selection marker having the necessary regulatory regions for expression in a recombinant organism to provide for selection of transformant cells. The gene can provide for resistance to a cytotoxic agent (e.g., an antibiotic, heavy metal, or toxin), complementation providing prototrophy to an auxotrophic host, viral immunity, or the like. Depending upon the number of different host species into which the expression construct or components thereof are introduced, one or more markers can be employed where different conditions for selection are used for the different hosts.

Specific, non-limiting, examples of suitable selection markers include genes that confer resistance to bleomycin, erythromycin, gentamycin, glyphosate, hygromycin, kanamycin, methotrexate, nalidixic acid, phleomycin, phosphinotricin, spectinomycin, streptomycin, sulfonamide, sulfonylureas, ampicillin/carbenicillin, chloramphenicol, streptomycin/spectinomycin, or tetracycline. Another example of a suitable selection marker is the auxotrophic selectable marker genes, such as histidine selectable marker genes. Specific, non-limiting, examples of markers include, but are not limited to, alkaline phosphatase (AP), myc, hemagglutinin (HA), 13 glucuronidase (GUS), luciferase, and green fluorescent protein (GFP). Preferably, the isolated nucleic acid further comprises a selection marker coupled to the nucleic acid encoding the polypeptide. The selection marker can be ampicillin/carbenicillin resistance, kanamycin resistance, chloramphenicol resistance, erythromycin resistance, streptomycin/spectinomycin resistance, or a histidine auxotrophic selectable marker gene.

In addition, expression vectors also can contain marker sequences operatively linked to a nucleotide sequence for a protein that encodes an additional protein used as a marker. The result is a hybrid or fusion protein comprising two linked and different proteins. The marker protein can provide, for example, an immunological or enzymatic marker for the recombinant protein produced by the expression vector. Additionally, the end of the polynucleotide can be modified by the addition of a sequence encoding an amino acid sequence useful for purification of the protein produced. For example, a DNA sequence encoding an amino acid sequence conferring affinity to a particular method of chromatography can be included. Various methods have been devised for the addition of such affinity purification moieties to proteins. Representative examples can be found in U.S. Pat. Nos. 4,703,004, 4,782,137, 4,845,341, 5,935,824, and 5,594,115. Any method known in the art for the addition of nucleotide sequences encoding purification moieties can be used (see, e.g., Sambrook et al., supra).

In particular, the invention provides recombinant constructs that include one or more isolated nucleic acids that encode Ole proteins or variants and homologs thereof. The constructs can include a vector, such as a plasmid or viral vector, into which the sequence has been inserted, either in the forward or reverse orientation. The recombinant construct can further include a regulatory sequence, including, for example, a promoter operatively linked to the sequence. Large numbers of suitable vectors and promoters are known and are commercially available. In one embodiment, the pET-21b(+), pCOLADuet-1, pCDFDuet-1, pcDNA3.1(+), pCMV SPORT6.1 (Invitrogen) vectors, or any of the vectors described herein are used. However, any suitable plasmids or vectors can be used as long as they are replicable and viable in the host.

The invention provides a vector comprising an isolated nucleic acid. For example, the vector can be a plasmid. Preferably, the vector is a plasmid selected from pET21b(+), pCOLADuet-1, pCDFDuet-1, pACYCDuet-1, pACYCpTrc, pCL1920pTrc, pESC-HIS, pSUP104, pMM1522, pWH1520, and pHT01. In a preferred embodiment, the vector is a plasmid selected from pET21b(+), pCOLADuet-1, pCDFDuet-1, pWH1520, pHT01, pESC-HIS, pET-21d(+), pETDuet-1, pACYCDuet-1, pTrcHis2A, pMAL-c2X, or pCL1920pTrc.

Recombinant DNA technology resulting in the integration of the respective nucleic acids encoding OleA (e.g., SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487), OleB (e.g., SEQ ID NO: 10 and SEQ ID NOs: 230-326), OleC (e.g., SEQ ID NO: 6, SEQ ID NO: 14, SEQ ID NO: 20, SEQ ID NO: 88, and SEQ ID NOs: 327-402), OleD (e.g., SEQ ID NO: 8, SEQ ID NO: 16, SEQ ID NO: 22, SEQ ID NOs: 142-149, and SEQ ID NOs: 403-464), OleBC (e.g., SEQ ID NOs: 135-141), and/or variants and homologs of these sequences into the chromosome of any living organism can result in expression and production of the respective proteins.

The isolated nucleic acid also can be part of an expression cassette that, at a minimum, includes a promoter, one or more isolated nucleic acids encoding OleA, OleB, OleC, OleD, or OleBC, and a transcriptional termination signal sequence functional in a recombinant organism. The promoter can be any of the types discussed herein, for example, an inducible promoter or constitutive promoter. The expression cassette can further include an operably linked targeting sequence or transit or secretion peptide coding region capable of directing transport of the protein produced. The expression cassette can also further include a nucleic acid sequence encoding a selectable marker and/or a purification moiety.

Regulatory sequences, coding sequences, and combinations thereof, can be introduced or altered in the genome of the host strain. In some examples, the integration of the desired recombinant sequence into the recombinant organism's genomic sequence does not require the use of a selectable marker, such as an antibiotic. In some examples, the genomic alterations include changing the control sequence of the target genes, such as oleA, oleB, oleC, oleBC, or oleD by replacing the native promoter(s) with a promoter insensitive to regulation. There are numerous approaches to do this. For example, Valle and Flores, *Methods Mol. Biol.* 267: 113-122 (2006) describes a PCR-based method to overexpress chromosomal genes in *E. coli*. Another approach is based on the use of single-strand oligonucleotides to create specific mutations directly in the chromosome using the technology developed by Costantino et al., *Proc. Nat. Acad. Sci.* 100: 15748-15753 (2003). This technology is based on the use of the overexpression of the beta protein from the bacteriophage lambda to enhance genetic recombination. The advantages of this approach are that synthetic oligonucleotides 70 or more bases long can be used to create point mutations, insertions, and deletions. This method eliminates cloning steps. Furthermore, the system is so efficient that no markers are necessary to isolate the desired mutations. This approach is useful for overexpressing, among other things, endogenous coding sequences, such as those that encode OleA, OleB, OleC, OleD, OleBC, or fatty acid biosynthetic pathway enzymes.

The invention provides an isolated nucleic acid further comprising at least one additional nucleic acid sequence selected from the group consisting of (a) a regulatory sequence operatively coupled to the nucleic acid encoding the polypeptide; (b) a selection marker operatively coupled to the nucleic acid encoding the polypeptide; (c) a purification moiety operatively coupled to the nucleic acid encoding the polypeptide; (d) a secretion sequence operatively coupled to the nucleic acid encoding the polypeptide; and (e) a targeting sequence operatively coupled to the nucleic acid encoding the polypeptide.

The invention also provides a cell comprising an isolated nucleic acid. In particular, the cell can comprise an isolated nucleic acid or a vector comprising an isolated nucleic acid. The cell can be transformed with an isolated nucleic acid using any suitable method known in the art. Alternatively, the cell can be transfected with a vector using any suitable method known in the art.

As used herein, the term "transfect" means the introduction of a nucleic acid (e.g., via an expression vector) into a recipient cell by nucleic acid-mediated gene transfer. As used herein, "transform" refers to a process in which a cell's genotype is changed as a result of the cellular uptake of exogenous DNA or RNA. This may result in the transformed cell expressing a recombinant form of an RNA or polypeptide. In the case of antisense expression from the transferred gene, the expression of a naturally-occurring form of the polypeptide is disrupted.

The cell can be a yeast cell, a fungal cell, an algae cell, an animal cell, an insect cell, a bacterial cell, or a plant cell. The cell can be an Archaea cell. In one embodiment, the cell is a bacterial cell.

The cell can be selected from any cell of the genus *Escherichia, Bacillus, Lactobacillus, Rhodococcus, Pseudomonas, Aspergillus, Trichoderma, Neurospora, Fusarium, Humicola, Rhizomucor, Kluyveromyces, Pichia, Mucor, Myceliophtora, Penicillium, Phanerochaete, Pleurotus, Trametes, Chrysosporium, Saccharomyces, Schizosaccharomyces, Stenotrophamonas, Kineococcus, Yarrowia,* or *Streptomyces*. Specifically, the cell can be a *Bacillus lentus* cell, a *Bacillus brevis* cell, a *Bacillus stearothermophilus* cell, a *Bacillus licheniformis* cell, a *Bacillus alkalophilus* cell, a *Bacillus coagulans* cell, a *Bacillus circulans* cell, a *Bacillus pumilis* cell, a *Bacillus thuringiensis* cell, a *Bacillus clausii* cell, a *Bacillus megaterium* cell, a *Bacillus subtilis* cell, or a *Bacillus amyloliquefaciens* cell. Additionally, the cell can be a *Trichoderma koningii* cell, a *Trichoderma viride* cell, a *Trichoderma reesei* cell, a *Trichoderma longibrachiatum* cell, an *Aspergillus awamori* cell, an *Aspergillus fumigates* cell, an *Aspergillus foetidus* cell, an *Aspergillus nidulans* cell, an *Aspergillus niger* cell, an *Aspergillus oryzae* cell, a *Humicola insolens* cell, a *Humicola lanuginose* cell, a *Rhizomucor miehei* cell, or a *Mucor michei* cell.

In a preferred embodiment, the cell is a *Streptomyces lividans* cell, a *Streptomyces murinus* cell, an *Actinomycetes* cell, or an *Escherichia coli* cell. The *Escherichia coli* cell can be a strain B, a strain C, a strain K, or a strain W *Escherichia coli* cell. The cell can also be a *Stenotrophomonas maltophilia* cell, a *Kineococcus radiotolerans* cell, a *Bacillus megaterium* cell, or a *Saccharomyces cerevisiae* cell.

More specifically, the cell can be any strain of *Anaeromyxobacter* sp. Fw109-5, *Arthrobacter aurescens, Arthrobacter chlorophenolicus, Arthrobacter* sp. FB24, *Bdellovibrio bacteriovorus, Blastopirellula marina, Brevibacterium linens, Burkholderia ambifaria, Burkholderia cenocepacia, Burkholderia oklahomensis, Burkholderia pseudomallei, Burkholderia* sp. 383, *Candidatus Kuenenia stuttgartiensis, Chloroflexus aggregans, Chloroflexus aurantiacus, Clavibacter michiganensis* subsp. *michiganensis, Clavibacter michiganensis* subsp. *Sepedonicus, Clostridium botulinum, Colwellia psychrerythraea, Congregibacter litoralis, Desulfatibacillum alkenivorans, Desulfococcus oleovorans, Desulfotalea psychrophila, Desulfuromonas acetoxidans, Flavobacteriales bacterium, Gemmata obscuriglobus, Geobacter bemidjiensis, Geobacter lovleyi, Geobacter* sp. FRC-32, *Geobacter uraniumreducens, Hahella chejuensis, Jannaschia* sp. CCS1, *Kineococcus radiotolerans, Lentisphaera araneosa, Maricaulis marls, Marinobacter algicola, Marinobacter aquaeolei, Micrococcus luteus, Microscilla marina, Moritella* sp. PE36, *Mycobacterium avium, Mycobacterium avium* subsp. *paratuberculosis, Mycobacterium marinum, Mycobacterium* sp. GP1, *Mycobacterium tuberculosis, Mycobacterium vanbaalenii, Neisseria gonorrhoeae, Nocardia farcinica, Opitutaceae bacterium, Opitutus terrae, Paenibacillus* sp. JDR-2, *Pelobacter propionicus, Photobacterium profundum, Photobacterium profundum, Photorhabdus luminescens* subsp. *laumondii, Planctomyces marls, Plesiocystis pacifica, Pseudoalteromonas atlantica, Psychromonas ingrahamii, Psychromonas* sp. CNPT3, *Ralstonia pickettii, Rhodococcus rhodochrous, Rhodococcus* sp., *Rhodopirellula baltica, Roseovarius nubinhibens, Shewanella amazonensis, Shewanella baltica, Shewanella benthica, Shewanella denitrificans, Shewanella frigidimarina, Shewanella halifaxensis, Shewanella loihica, Shewanella oneidensis, Shewanella pealeana, Shewanella putrefaciens, Shewanella sediminis, Shewanella* sp. ANA-3, *Shewanella* sp. MR-4, *Shewanella* sp. MR-7, *Shewanella* sp. W3-18-1, *Shewanella woodyi, Stenotrophomonas maltophilia, Streptomyces ambofaciens, Xanthomonas axonopodis, Xanthomonas campestris, Xanthomonas oryzae,* and *Xylella fastidiosa*.

Optionally, the cell can be an animal cell. For example, the animal cell can be selected from the group consisting of a CHO cell, a COS cell, a VERO cell, a BHK cell, a HeLa cell, a Cv1 cell, an MDCK cell, a 293 cell, a 3T3 cell, and a PC12 cell.

The invention also provides for a cell comprising an alteration in a gene involved in the fatty acid biosynthetic pathway. As used herein, the term "fatty acid biosynthetic pathway" means a biosynthetic pathway that produces fatty acids. The fatty acid biosynthetic pathway includes fatty acid enzymes that can be engineered, as described herein, to produce fatty acids, and in some embodiments can be expressed with additional enzymes to produce fatty acids having desired carbon chain characteristics.

As used herein, "fatty acid enzyme" means any enzyme involved in fatty acid biosynthesis. Fatty acid enzymes can be expressed or overexpressed in host cells to produce fatty acids. Non-limiting examples of fatty acid enzymes include fatty acid synthases and thioesterases.

For example, the cell can overexpress acyl-Coa synthase (EC 6.2.1.3, 2.3.1.86), thioesterase (EC 3.1.2.-, 3.1.1.15, 3.1.2.14), acetyl-CoA carboxylase (EC 6.4.1.2, 6.3.4.14), an acyl-carrier protein, pyruvate dehydrogenase (EC 1.2.4.1), aldehyde decarbonylase (EC 4.1.99.5), beta-hydroxydecanoyl thioester dehydrase (EC 4.2.1.60), 3-oxoacyl-[acyl-carrier-protein]synthase I (EC 2.3.1.41), [acyl-carrier-protein]S-malonyltransferase (EC 2.3.1.39), 3-oxoacyl-[acyl-carrier protein] reductase (EC 1.1.1.100), 3-oxoacyl-[acyl-carrier-protein] synthase III (EC 2.3.1.180), enoyl-[acyl-carrier-protein]reductase (EC 1.3.1.9), (3R)-hydroxymyristol acyl carrier protein dehydratase (EC 4.2.1.-), lipase (EC 3.1.1.3), malonyl-CoA decarboxylase (EC 4.1.1.9, 4.1.1.41), aspartate 1-decarboxylase (EC 4.1.1.11), pantothenate kinase (EC 2.7.1.33), pyruvate dehydrogenase (EC 1.2.4.1), pyridine nucleotide transhydrogenase (EC 1.6.1.1), and combinations thereof.

In addition to overexpressing one or more peptides to produce substrates containing fatty acyl chains, the cell can additionally have one or more peptides functionally deleted, mutated, or attenuated. As used herein, the term "attenuate" means to weaken, reduce or diminish. For example, a polypeptide can be attenuated by modifying the polypeptide to reduce its activity (e.g., by modifying a nucleotide sequence that encodes the polypeptide).

For example, one or more of the following can be deleted, mutated, or attenuated: acetate kinase (EC 2.7.2.1), alcohol dehydrogenase (EC 1.1.1.1, 1.2.1.10), 3-oxoacyl-[acyl-carrier-protein]synthase II (EC 2.3.1.179), FabR transcriptional repressor (accession NP_418398), acyl-CoA dehydrogenase (EC 1.3.99.3, 1.3.99.-), biosynthetic sn-glycerol 3-phosphate dehydrogenase (EC 1.1.1.94), lactate dehydrogenase (EC 1.1.1.28), formate acetyltransferase (EC 2.3.1.54), acyltransferase (EC 2.3.1.15), pyruvate oxidase (EC 1.2.2.2), and phosphotransacetylase (EC 2.3.1.8).

In some examples, the cell can produce branched products, including substrates containing fatty acyl chains, hydrocarbons, and hydrocarbon intermediates. Accordingly, cells can be engineered to increase branching by overexpressing a peptide selected from one or more components of the branch chain keto acid dehydrogenase complex (EC 1.2.4.4), branched-chain amino acid aminotransferase (EC 2.6.1.42), dihydrolipoamide dehydrogenase (E3) (EC 1.8.1.4), crotonyl-CoA reductase (EC 1.6.5.5, 1.1.1.1), isobutyryl-CoA mutase, subunit A (EC 5.4.99.2), isobutyryl-CoA mutase, subunit B (5.4.99.2), beta-ketoacyl-ACP synthase III (EC 2.3.1.180), beta-ketoacyl-ACP synthase II (EC 2.3.1.179), acyl-carrier protein (NP_823468), enoyl-CoA reductase (EC 1.3.1.34), enoyl-CoA isomerase (EC 4.2.1.-), and combinations thereof.

The saturation level of the substrate containing a fatty acyl chain, hydrocarbon, and hydrocarbon intermediate can be altered by engineering the cell to overexpress a peptide selected from 3-oxoacyl-[acyl-carrier-protein] synthase I (EC 2.3.1.41), trans-2-enoyl-ACP reductase II (EC 1.3.1.9), enoyl-(acyl carrier protein) reductase (EC 1.3.1.9), trans-2, cis-3-decenoyl-ACP isomerase (4.2.1.17), acyl-CoA dehydrogenase (EC 1.3.99.3, 1.3.99.-) and combinations thereof.

In addition to engineering the cell to produce hydrocarbons or hydrocarbon intermediates, environmental conditions, such as temperature, can also be regulated to change the types of hydrocarbons produced. For example lower temperatures can be used to produce higher numbers of double bonds in a hydrocarbon and higher temperatures may lead to higher levels of saturation. In 1962, Man and Ingraham published a paper demonstrating that temperature influences the degree of saturation in lipids produced by *E. coli* (Man et al., *J. Bacteriol.*, 84: 1260-7 (1962)). Low temperatures result in the production of lipids with a greater degree of unsaturation while higher temperatures result in higher quantities of saturated lipids (see, e.g., Example 14). Therefore, reducing the temperatures during production can alter the product to lead to higher degrees of unsaturation in hydrocarbons or hydrocarbon intermediates.

Preferably, the cell comprises an alteration in a gene encoding an acyl-CoA dehydrogenase. This alteration can be a deletion, a mutation, or an attenuation of a gene encoding acyl-CoA dehydrogenase. In another preferred embodiment, the cell comprises an alteration in a gene encoding a thioesterase. This alteration can be an overexpression of a gene encoding a thioesterase.

In some examples a peptide having acyl-CoA synthase activity is overexpressed. For example, acyl-CoA synthases such as fadD (NP_416319), fadK (NP_416216), fadD (YP_045024), fadD (NP_438551), BH3103 (NP_243969), yhfL (NP_388908), Pfl_4354 (YP_350082), fadD1 (NP_251989), fadD2 (NP_251990), fadD (YP_533919), RPC_4074 (YP_533919), fadD1 (NP_520978), fadD35 (NP_217021), fadD22 (NP_217464), and combinations thereof can be expressed, deleted, mutated, or attenuated. Another example of an acyl-CoA synthase is a fadD homolog from *Stenotrophomonas maltophilia* R551-3 (ZP_01644857.1).

In addition, thioesterase expression can be controlled to alter the amount of products and/or the carbon chain length of the products including fatty acyl chains. For example, thioesterases such as tesA without leader sequence (AAC73596), tesB (AAC73555), Uc fatB (Q41635, AAA34215), Ch fatB2 (Q39513, AAC49269), Ch fatB3 (AAC49269, AAC72881), Cc fatB (Q39473, AAC49151), At fatB [M1411] (CAA85388), At fatA (NP 189147, NP 193041), Ch fatA (AAC72883), Ha fatA1 (AAL79361), or combinations thereof can be expressed, deleted, mutated, or attenuated.

Optionally, the cell can comprise an acyl-CoA synthase or a thioesterase. For example, the cell can be transformed with an isolated nucleic acid encoding an acyl-CoA synthase or a thioesterase. Alternatively, the cell can be transfected with a vector comprising an isolated nucleic acid encoding an acyl-CoA synthase or a thioesterase.

Recombinant organisms can be engineered using the isolated nucleic acids and proteins disclosed herein to produce hydrocarbons and aliphatic ketones that have defined structural characteristics (e.g., degrees of branching, saturation, or carbon chain length). One method of making hydrocarbons involves increasing the expression of, or expressing more active forms of, one or more acyl-condensing enzymes (enzymes that condense more than one acyl-CoA, acyl-ACP, acyl-AMP, acyl-ester, fatty acid, or mixtures thereof). One of ordinary skill in the art will appreciate that the products produced from such condensation reactions vary with the acyl chain that is condensed. Products that can be produced include, for example, hydrocarbons and hydrocarbon intermediates, such as aliphatic ketones.

One of ordinary skill in the art will appreciate that substrates containing a fatty acyl chain and intermediates thereof can be produced using in vitro reactions, including chemical or enzymatic conversions, as well as through in vivo reactions. Additionally, a combination of in vivo and in vitro conversions can be utilized. Moreover, specific aliphatic ketones can be produced by selectively providing selected substrates, such as fatty acids, acyl-ACP, or acyl-CoA for the conversion. Alternatively, hydrocarbons can be produced by selectively providing selected substrates, such as fatty acids, acyl-ACP, acyl-CoA, aliphatic ketones, α-alkyl-β-keto acids, or α-alkyl-β-keto esters for the conversion.

As used herein, the term "fatty acid" means a carboxylic acid having the formula RCOOH. R represents an aliphatic group, preferably an alkyl group. R can comprise between about 4 and about 22 carbon atoms. Fatty acids can be saturated, mono-unsaturated, or poly-unsaturated. In a preferred embodiment, the fatty acid is made from a fatty acid biosynthetic pathway.

The terms "convert" or "conversion" refer to the use of either chemical means or biological means (e.g., polypeptides in a reaction) which changes a first intermediate or substrate to a second intermediate or product. The term "chemical conversion" refers to reactions that are not actively facilitated by polypeptides. The term "biological conversion" refers to reactions that are actively facilitated by polypeptides. Conversions can take place in vivo, in vitro, or both. When biological conversions are used, the peptides and/or cells can be immobilized on supports, such as by chemical attachment onto polymer supports. The conversions can be accomplished using any reactor known to one of ordinary skill in the art, for example in a batch or a continuous reactor.

The recombinant organism can convert several intermediates to subsequent intermediates or the recombinant organism can be fed, or placed in contact with, an intermediate that is converted to a product. In certain examples, the recombinant organism is placed in contact with an intermediate, such as an acyl-CoA molecule and that acyl-CoA molecule is then converted into a product.

Given the disclosure provided herein, large scale enzyme production of the Ole proteins (e.g., OleA, OleB, OleC, OleD, and OleBC) and homologs thereof is now possible. Briefly, the coding sequences from any one of these peptides or homologs of these peptides (see, e.g., Tables 1 and 2) can be cloned into a high expression plasmid, such as pET-21b(+), pCOLADuet-1 (EMD Chemicals, Inc., Germany), pWH1520 (Mo Bi Tec, Germany) or pHT01 (Mo Bi Tec, Germany). The plasmid can be introduced into a host cell for production of the enzymes. The resulting peptides can then be purified and used in batch production.

When in vitro methods are used, the peptides supplied to the reaction will depend upon the starting material. For example, when a hydrocarbon is desired, acyl-ACP and/or acyl-CoA substrates would be added to an in vitro reaction mixture containing OleA, OleC, and OleD. Similarly, when the starting material is an aliphatic ketone, α-alkyl-β-keto acids, or α-alkyl-β-keto esters, the peptides OleC and OleD can be used in the in vitro reaction.

When a first peptide is used to convert a first intermediate to a second intermediate and then a second peptide is used to convert the second intermediate to a third intermediate, the peptides can be added to the reaction simultaneously or serially. In some examples, where the peptides are added serially, the first peptide can be removed prior to the addition of the second peptide.

Additionally, a combination of chemical conversions and biological conversions can be used to produce a desired product. For example, one of ordinary skill in the art will appreciate that two fatty acids can be condensed to make an aliphatic ketone via chemical conversion, and the resulting aliphatic ketone can then be converted to a hydrocarbon using biological conversions.

Given the disclosure provided herein, aliphatic ketones, hydrocarbons, and intermediates thereof can be produced in a recombinant cell. The recombinant cell can produce one or more peptides encoded by OleA, OleB, OleC, OleD, OleBC and related sequences thereof. One of ordinary skill in the art will appreciate that the choice of peptides to express in the recombinant cell will depend upon the desired product and the starting material provided to the cells. For example, if the cell will be supplied with aliphatic ketones and the desired product is a hydrocarbon, then the recombinant cell can be engineered with a nucleotide acid encoding OleC and OleD.

The in vivo methods described herein can also be used in combination with chemical conversions and in vitro biological conversions. For example, a first intermediate can be converted to a second intermediate using a peptide in vitro; the second intermediate can then be fed to a cell that expresses peptides necessary for the conversion of the second intermediate to a third intermediate. In another example, a first intermediate can be converted to a second intermediate via chemical conversion, and then the second intermediate can be fed to a recombinant cell encoding the peptides necessary for subsequent conversions.

Additionally, products can be produced using two or more in vivo reaction steps. For example, a first recombinant cell can be used to convert a first intermediate to a second intermediate. The second intermediate can be released from the cell, for example through passive transport, active transport, or cell lysis, and the second intermediate can then be fed to a second recombinant cell where it is converted to a third intermediate. In some examples, the third intermediate will be the desired product.

The invention allows for the large scale production of aliphatic ketones, hydrocarbons, and hydrocarbon intermediates that have defined carbon chain lengths, saturation levels, and branch points. The production of such engineered molecules provides a diversity of products that can be used as fuels and specialty chemicals.

The invention provides a cell transformed with any of the nucleic acids disclosed herein (e.g., nucleic acid sequences encoding any of the polypeptide sequences disclosed herein) or transfected with any of the vectors disclosed herein. Preferably, the cell produces a hydrocarbon or an aliphatic ketone. The hydrocarbon can be an olefin. In one embodiment, the hydrocarbon or aliphatic ketone is secreted by the cell. In a preferred embodiment, the cell comprises an isolated nucleic acid encoding OleA. Specifically, the cell comprising an isolated nucleic acid encoding OleA can be a *Saccharomyces cerevisiae* cell.

The invention provides a method for producing a hydrocarbon comprising, culturing any cell comprising any of the isolated nucleic acids disclosed herein (e.g., nucleic acid sequences encoding any of the polypeptide sequences disclosed herein) with a substrate under conditions sufficient to produce a hydrocarbon. For example, the substrate can be a carbon source, fatty acid, acyl-CoA, acyl-AMP, acyl-ACP, α-alkyl-β-keto acid, α-alkyl-β-keto ester, or an aliphatic ketone. Preferably, the productivity of the cell is at least about 3 mg/L/OD$_{600}$. For example, the productivity of the cell can be at least about 5 mg/L/OD$_{600}$, at least about 8 mg/L/OD$_{600}$, at least about 15 mg/L/OD$_{600}$, at least about 20 mg/L/OD$_{600}$, or at least about 30 mg/L/OD$_{600}$.

The invention further provides a method for producing a hydrocarbon comprising, culturing any cell comprising an isolated nucleic acid disclosed herein (e.g., a nucleic acid sequence encoding any of the polypeptide sequences disclosed herein) with a substrate under conditions sufficient to produce a hydrocarbon comprising isolating a hydrocarbon. The hydrocarbon can be isolated from the cell or from the medium in which the cell is cultured. The substrate can be, for example, a carbon source, fatty acid, acyl-CoA, acyl-AMP, acyl-ACP, α-alkyl-β-keto acid, α-alkyl-β-keto ester, or an aliphatic ketone.

The invention provides a method for producing a hydrocarbon comprising, culturing any cell comprising the isolated nucleic acids disclosed herein (e.g., a nucleic acid sequence encoding any of the polypeptide sequences disclosed herein) with a substrate (e.g., a carbon source, fatty acid, acyl-CoA, acyl-AMP, acyl-ACP, α-alkyl-β-keto acid, α-alkyl-β-keto ester, or an aliphatic ketone) under conditions sufficient to produce a hydrocarbon further comprising cracking or refining the hydrocarbon.

The method can produce a hydrocarbon that is monounsaturated or polyunsaturated (e.g., diunsaturated, triunsaturated, etc.). The hydrocarbon can have a carbon chain length of between about 10 to about 40 carbons. For example, the hydrocarbon can have a carbon chain length of between about 15 to about 35, about 17 to about 34, 18 to about 33, about 19 to about 33 carbons, between about 27 to about 33 carbons, between about 29 to about 31 carbons, or about 19, 20, 21, 22, 23, 24, 25, 26, 27, 28, 29, 30, 31, 32, or 33 carbons.

The invention provides a method for producing an aliphatic ketone comprising culturing any cell comprising the isolated nucleic acids disclosed herein (e.g., a nucleic acid sequence encoding any of the polypeptide sequences disclosed herein)

with a substrate under conditions sufficient to produce an aliphatic ketone. For example, the substrate can be a carbon source, fatty acid, acyl-CoA, acyl-AMP, acyl-ACP, α-alkyl-β-keto acid, or α-alkyl-β-keto ester. Preferably, the productivity of the cell is at least about 0.1 mg/L/OD$_{600}$. For example, the productivity of the cell can be at least about 0.1 mg/L/OD$_{600}$, at least about 1 mg/L/OD$_{600}$, at least about 3 mg/L/OD$_{600}$, at least about 6 mg/L/OD$_{600}$, at least about 9 mg/L/OD$_{600}$, or at least about 12 mg/L/OD$_{600}$.

The invention further provides a method for producing an aliphatic ketone comprising culturing any cell comprising the isolated nucleic acids disclosed herein with a substrate under conditions sufficient to produce an aliphatic ketone comprising isolating an aliphatic ketone. The aliphatic ketone can be isolated from the cell or from the medium in which the cell is cultured The method can produce an aliphatic ketone that is saturated, mono-unsaturated, or poly-unsaturated (e.g., di-unsaturated, tri-unsaturated, etc.). The aliphatic ketone can have a carbon chain length of about 10 to about 40 carbons. For example, the aliphatic ketone can have a carbon chain length of between about 15 to about 35, about 17 to about 34, 18 to about 33, about 19 to about 33 carbons, between about 23 to about 29 carbons, between about 25 to about 27 carbons, or about 19, 20, 21, 22, 23, 24. 25, 26, 27, 28, 29, 30, 31, 32, or 33 carbons.

The invention also provides a method for producing a purified polypeptide comprising culturing any cell comprising an isolated nucleic acid disclosed herein under conditions sufficient to produce the polypeptide encoded by the isolated nucleic acid. Specifically, the polypeptide is OleA, OleB, OleC, OleD or OleBC.

As used herein, the term "purify," "purified," or "purification" means the removal or isolation of a molecule from its environment by, for example, isolation or separation. "Substantially purified" molecules are at least about 60% free, preferably at least about 75% free, and more preferably at least about 90% free from other components with which they are associated. As used herein, these terms also refer to the removal of contaminants from a sample. For example, the removal of contaminants can result in an increase in the percentage of olefins in a sample. For example, when olefins are produced in a host cell, the olefins can be purified by the removal of host cell proteins. After purification, the percentage of olefins in the sample is increased.

As used herein, the terms "purify," "purified," and "purification" do not require absolute purity. They are relative terms. Thus, for example, when polypeptides are produced in cells, a purified polypeptide is one that is substantially separated from other cellular components (e.g., nucleic acids, lipids, carbohydrates, or hydrocarbons). In another example, a purified olefin preparation is one in which the olefin is substantially free from contaminants, such as those that might be present following fermentation. In some embodiments, an olefin is purified when at least about 50% by weight of a sample is composed of the olefin. In other embodiments, an olefin is purified when at least about 60%, 70%, 80%, 85%, 90%, 92%, 95%, 98%, or 99% or more by weight of a sample is composed of the olefin.

The invention provides a method for producing an aliphatic ketone comprising incubating a substrate with OleA, under conditions sufficient for producing an aliphatic ketone. Specifically, the substrate can comprise acyl-CoA, acyl-AMP, or acyl-ACP.

The invention provides a method for producing a hydrocarbon comprising incubating a substrate with OleA, OleB, OleC, OleD, OleBC, or a combination thereof under conditions sufficient for producing a hydrocarbon. The substrate can comprise acyl-CoA, acyl-AMP, or acyl-ACP. The OleA, OleB, OleC, OleD, or OleBC proteins used to produce a hydrocarbon can be purified or unpurified proteins. For example, an acyl-CoA substrate can be added to a cell lysate from an organism expressing the ole genes to produce hydrocarbons.

The method for producing a hydrocarbon can comprise incubating a substrate with OleA and OleD under conditions sufficient for producing a hydrocarbon. Optionally, the method can comprise OleB. The method can comprise incubating a substrate with OleA, OleC, and OleD under conditions sufficient for producing a hydrocarbon. Optionally, the method can comprise OleB.

Acyl-condensing peptides include peptides capable of catalyzing the condensation of acyl-ACP, acyl-CoA, acyl-AMP, fatty acids, and mixtures thereof using the methods described herein. In some embodiments, these acyl-condensing peptides are have high, medium, or low substrate specificity. In some examples, the acyl-condensing peptides are more substrate specific and will only accept substrates of a specific chain length. Additionally, one of ordinary skill in the art will appreciate that some acyl-condensing peptides will catalyze other reactions as well. For example, some acyl-condensing peptides will accept other substrates in addition to acyl-CoA, acyl-ACP, acyl-AMP, acyl-ester, fatty acid, or mixtures thereof. Such non-specific acyl-condensing peptides are, therefore, also included. Examples of acyl-condensing enzymes, in addition to the OleA sequences provided in Table 1, are publicly available.

In an alternate embodiment, OleC and OleD can be used to produce olefins without OleA. In another embodiment, OleC can be used to produce olefins without OleA and OleD.

Mycolic acids are 2-alkyl-3-hydroxy fatty acids produced by bacteria (e.g., *Mycobacterium* and *Corynebacterium*). Mycolic acids are often incorporated into bacterial cell walls. These 2-alkyl-3-hydroxy fatty acids are derived from a Claisen condensation followed by a reduction of the keto group. This reaction is similar to the enzymatic reactions performed by OleA and OleD in the hydrocarbon synthesis process described herein. Hence, the first steps in of the mycolic acid pathway can be used to produce the substrates necessary for OleC or the combination of OleC and OleD to produce hydrocarbons. In addition, further genetic modifications to the mycolic acid pathway could increase alkene production levels.

Figure 20:
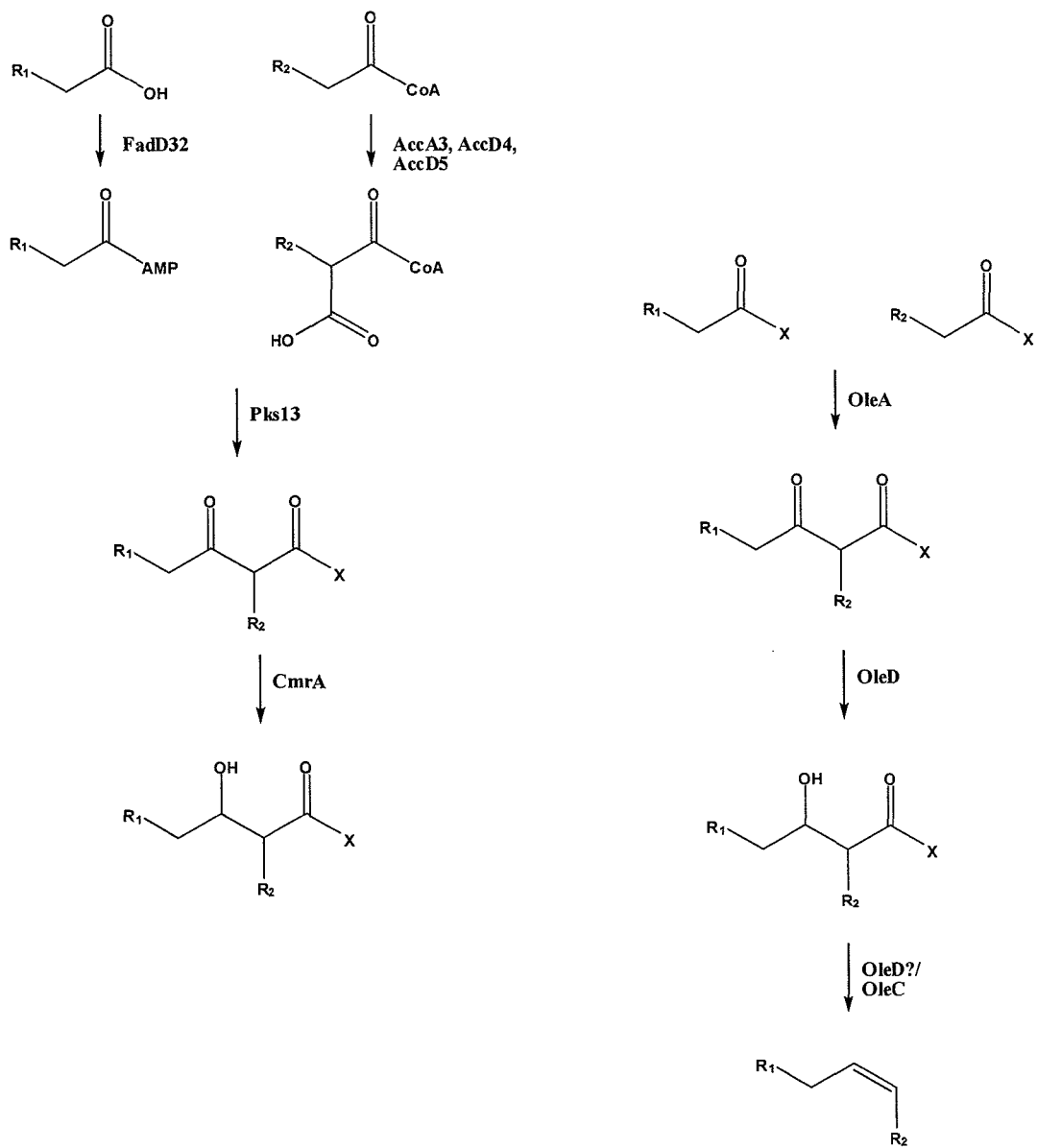
FIG. 20 is a diagram of proposed pathways for mycolic acid biosynthesis and olefin synthesis using OleA, OleB, OleC, and OleD. X may be either CoA or ACP.

FIG. 20 outlines a proposed synthetic pathway for mycolic acid biosynthesis (see, e.g., Lea-Smith et al., *Journal of Biological Chemistry*, 282: 11000-11008 (2007) and Portevin et al., *Proceedings of the National Academy of Science*, 101: 314-319 (2004)) and for olefin synthesis by the ole genes. Examination of these two pathways reveals similar intermediates. The product of fatty acid condensation in both pathways is a 2-alkyl-3-keto fatty acyl-CoA or 2-alkyl-3-keto fatty acyl-ACP. As a result, overexpression of oleC and oleD in a mycolic acid producing organism, such as *C. glutamicum*, may "hijack" the mycolic acid biosynthesis pathway leading to the production of olefins.

Figure 21:
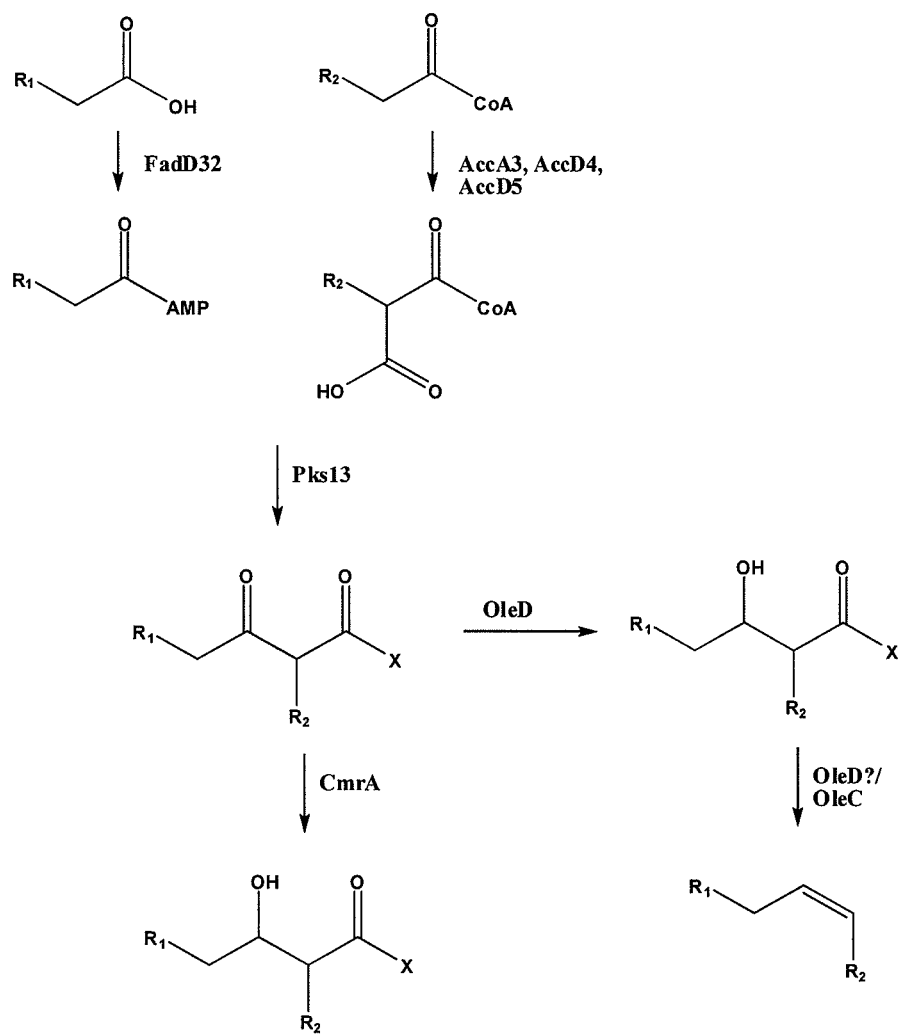
FIG. 21 is a diagram of a proposed pathway for long chain olefin production in a mycolic acid producing organisms expressing oleC and oleD.

In the first scheme, oleC and oleD are overexpressed in a mycolic acid producing organism. An appropriate host organism could be *C. glutamicum*, a well established industrial host with well worked out genetic tools that is tolerant to the loss of mycolic acid production. The fatty acid specificity of *C. glutamicum*'s mycolic acid genes is similar to the specificity profiles observed for oleA, oleB, oleC, and oleD. The overexpression of oleC and oleD would direct the product of pks13 towards olefin synthesis as outlined in FIG. 21.

Figure 22:
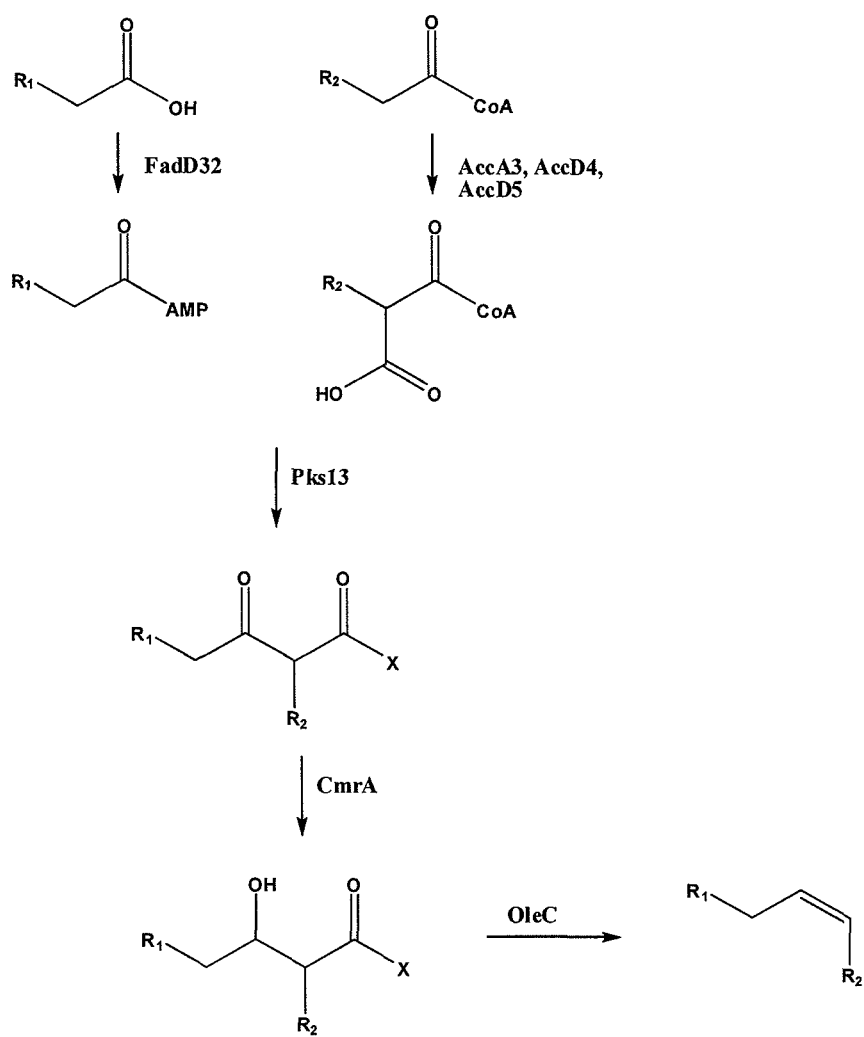
FIG. 22 is a proposed pathway for long chain olefin production in a mycolic acid producing organisms expressing oleC.

In the second scheme, only oleC is overexpressed in a mycolic acid producing organism. This proposed scheme assumes OleC can operating independently on a 2-alkyl-3-hydroxyl fatty acyl intermediate to form olefins. This pathway is highlighted in FIG. 22.

Enhancement of olefin production in a mycolic acid producing strain expressing oleC and oleD can be obtained by completing the following genetic modifications. To prevent the siphoning off of substrates for OleC and OleD, cmrA, or its functional homologue, can be knocked out to prevent the formation of mycolic acid while allowing for the accumulation of 2-alkyl-3-keto fatty acyl-ACP, a substrate for OleD. Additionally, the overexpression of fadD32, accA3, accD4, accD5, or pks13 should increase the production of required mycolic acid intermediates, resulting in greater production of olefins with the overexpression of oleC and oleD.

Generally, there are several methods of identifying peptides having acyl-condensing activity. Product formation using one or more of these methods indicates that the peptide has acyl-condensing activity. In addition to the in vitro assays provided in Example 3, the peptide can be expressed from an exogenous nucleic acid in a cell and then a cell lysate can be prepared. Various substrates such as acyl-CoA, acyl-ACP, acyl-AMP, acyl-ester, fatty acid, or mixtures thereof can be added to the lysate and products can be detected using the GC/MS or GC/FID methods described herein. In another example, the peptide can be purified and incubated with cell lysate from a cell that is not expressing the peptide (hereinafter, wild-type lysate). The purified peptide, wild-type lysate, and various substrates can be incubated. The resulting products can be characterized using the GC/MS or GC/FID methods described herein. In yet another example, acyl-condensing activity can be characterized by incubating purified enzyme and substrate in the presence of cell lysate that has been heated to denature proteins. In another example, purified peptide and various substrates can be incubated, and the resulting product can be characterized using the GC/MS methods described herein. Peptides having acyl-condensing activity are identified as those that produce aliphatic ketones. One of ordinary skill in the art will appreciate that when a cell lysate is used that already contains aliphatic ketones, peptides having acyl-condensing activity will be recognized by an increase in aliphatic ketones compared to the lysate without the addition of substrate (such as an increase of at least about 10%, at least about 20%, at least about 50%, or at least about 90%).

In some cases, the condensation can result in the production of molecules derived from one or more of the substrates. For example, the condensation of two acyl-CoA molecules may produce at least one molecule of CoA. As CoA has a free thiol moiety (RSH), which is highly reactive, this molecule can be detected by a variety of methods. One such method is reaction with dithionitrobenzoic acid (Ellman's reagent) which can be followed spectrophotometrically at 411 nm. Alternatively, CoA can be reacted with monobromobimane and detected by HPLC (Fahey, et al., *Methods Enzymol.* 143: 85-96, (1987)).

Bioinformatic methods can be used to find acyl-condensing peptides. Acyl-condensations occur through a well known chemical reaction known as the "Claisen condensation". The Claisen condensation is a carbon-carbon bond forming reaction that occurs between two esters or one ester and another carbonyl compound in the presence of a strong base resulting in a β-keto ester or a β-diketone.

Acyl-condensation peptides typically contain a catalytic triad composed of Cys-His-Asn. The condensing enzymes share a common 3-dimensional fold, although they share little similarity at the amino acid level. Their active sites, however, possess significant similarities. (Heath et al, *Nat. Prod. Rep.*, 19: 581-596, (2002)).

Exemplary acyl-condensing peptides include the OleA sequences disclosed herein, for example, SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 88, SEQ ID NOs: 135-464, and SEQ ID NOs 478-487, homologs of these sequences, enzymes having one or more of the OleA structural motifs provided herein, and active fragments/variants thereof that display acyl-condensing activity.

Recombinant organisms can be engineered using the peptides disclosed herein to produce hydrocarbons and hydrocarbon intermediates having defined structural characteristics (degrees of branching, saturation, and carbon chain length). One method of making hydrocarbon intermediates involves expressing, increasing the expression of, or expressing more active forms of, one or more enzymes, for example, hydrocarbon synthase activity, adenylating peptides, dehydrogenases, dehydratases, or acyl-condensing enzymes. Exemplary enzymes that can be manipulated to increase hydrocarbon production include OleA, OleB, OleC, OleBC, and OleD, as well as other enzymes that increase or modify fatty acid production. One of ordinary skill in the art will appreciate that the products produced from such enzymes vary with the acyl chain of the substrate.

Adenylating peptides include peptides capable of catalyzing the addition of adenosine monophosphate to hydrocarbon intermediates, such as a β-ketoacid, including α-substituted-β-ketoacids, particularly those including an aliphatic hydrocarbon at the α position. As described above, the α-aliphatic group in such intermediates typically is an optionally branched hydrocarbon chain optionally including one or more sites of unsaturation, for example, one, two, or three sites of unsaturation in the hydrocarbon chain. Such adenylating peptides also may be capable of catalyzing the addition of adenosine monophosphate to β-hydroxy keto acids to form a β-ketoester. Methods of identifying such activity are provided herein.

In some examples, the adenylating peptides are more substrate specific and will only accept, for example, CoA or ACP activated β-ketoesters. Additionally, one of ordinary skill in the art will appreciate that some adenylating peptides reactions as well. For example, some adenylating peptides will accept other substrates in addition to α-substituted β-keto acids. Such relatively non-specific adenylating peptides are, therefore, also included. Examples of adenylating peptides are publicly available (see, e.g., Tables 1 and 2). Often the adenylating peptide catalyzes additional further reactions, such as the transesterification of the adenylated compound with other activating groups, such as CoA. This activity is considered synthase activity. An example would be the following set of reactions:

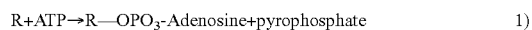

R+ATP→R—OPO$_3$-Adenosine+pyrophosphate   1)

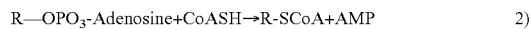

R—OPO$_3$-Adenosine+CoASH→R-SCoA+AMP   2)

There are several methods of identifying peptides having adenylating activity. Product formation using one or more of these methods indicates that the peptide has adenylating activity. In addition to the in vivo assays provided herein, the peptide can be expressed from an exogenous nucleic acid in a cell and then a cell lysate can be prepared. Various substrates such as ATP can be added to the lysate, and products can be detected using the methods described herein. In another example, the peptide can be purified and incubated with cell lysate from a cell that is not expressing the peptide. The purified peptide, wild-type lysate, and various substrates can be incubated. The resulting products can be characterized using the methods described herein. One of ordinary skill in the art will appreciate that when a cell lysate that already contains adenylated products is used, peptides having adenylating activity will be recognized by an increase in either free PPi, AMP α-substituted-β-ketoesters, or AMP α-substituted-β-hydroxyesters compared to the lysate without the addition of substrate. Exemplary adenylating peptides include OleC (e.g., SEQ ID NO: 6), the OleC proteins listed in Table 1, and active fragments/variants thereof which display adenylating activity.

Dehydrogenase peptides include peptides capable of catalyzing the reduction of a keto group in an aliphatic-ketone, an aliphatic β-ketoacid, or an aliphatic β-ketoester molecule to the corresponding hydroxy group (the addition of $H_2$ across the carbon-oxygen double bond). Methods of identifying such activity are provided herein. In some examples, the dehydrogenase peptides are more substrate specific and will only accept, for example, CoA or ACP esters of α-aliphatic-β-ketoesters. Additionally, one of ordinary skill in the art will appreciate that some dehydrogenase peptides will catalyze other reactions as well. For example, some dehydrogenase peptides will accept other substrates in addition to β-ketoesters. Such non-specific dehydrogenase peptides are, therefore, also included. Examples of dehydrogenase peptides are OleD (e.g., SEQ ID NO: 8) and the publicly available dehydrogenases peptides provided in Table 1.

There are several methods of identifying peptides having dehydrogenase activity. Product formation using one or more of these methods indicates that the peptide has dehydrogenase activity. In addition to the in vivo assay provided herein, the peptide can be expressed from an exogenous nucleic acid sequence in a cell and then an in vitro assay containing cell lysate or purified peptide can be prepared. Various substrates, such as NADPH and/or NADH, can be added to the assay and products can be detected using the GC/MS methods described herein.

In another example, the peptide can be purified and incubated with cell lysate from a cell that is not expressing the peptide. The purified peptide, wild-type lysate, and various substrates (e.g., fatty acid, acyl-CoA, acyl-AMP, acyl-ACP, α-alkyl-β-keto acid, α-alkyl-β-keto ester, or an aliphatic ketone) can be incubated. The resulting products can be characterized using the methods described herein (see, e.g., Example 1).

In yet another example, dehydrogenase activity can be detected by spectrophotometrically monitoring the dehydrogenase dependent oxidation of the NADPH or NADH in the presence of the ketone substrate. The dehydrogenase activity is detected as a decrease in absorbance of the reaction solution at 340 nm.

In yet another example, dehydrogenase activity can be characterized by incubating purified enzyme and substrate (e.g., NAD(P)H, α-aliphatic-β-ketoesters, and/or α-aliphatic-β-ketoacids) in the presence of cell lysate that has been heated to denature proteins. Peptides having dehydrogenase activity are identified as those that produce β-hydroxy acid or ester (particularly, activated ester) molecules from one or more of the above-described reactions. One of ordinary skill in the art will appreciate that when a cell lysate is used that already contains β-hydroxy acid and/or ester products, peptides having dehydrogenase activity will be recognized by an increase in either NADP, β-hydroxy acid, and/or ester molecules compared to the lysate without the addition of substrate.

Exemplary dehydrogenase peptides include OleD (e.g., SEQ ID NO: 8) and the related enzymes shown in Table 1. Additional OleD enzymes can be identified by searching various databases using the OleD motifs provided herein and the methodology described herein.

Also disclosed herein are nucleic acids encoding a peptide having hydrolase activity. In particular, the peptide would have β-keto or β-hydroxy ester hydrolytic activity. Such a peptide likely would catalyze the hydrolysis of esters of all of the substrates described above to produce the corresponding carboxylic acid. Ester hydrolases can be detected by monitoring the production of product, such as the β-ketoacid or β-hydroxyacid by HPLC (or other well-known techniques). In another embodiment, the resulting decrease in pH due to the formation of the free acid can be monitored. Alternatively, ester hydrolysis can be monitored by measuring the accumulation of the moiety released from the fatty ester, such as CoASH, AMP, or phosphate. To those skilled in the art, methods for monitoring these compounds are well known and some of these methods are described above. Phosphate can be monitored, for example, by reaction with molybdate and malachite green. Additional assays can be obtained commercially (e.g., from BioVision, Inc., Mountain View, Calif.).

The invention provides an isolated polypeptide comprising, consisting essentially of, or consisting of, an amino acid sequence encoding OleA which comprises one or more (e.g., about 1, about 2, about 3, about 4, about 5, about 10, about 15, about 20, about 25, about 30, about 35, about 40, about 45, or about 50) amino acid substitutions, additions, insertions, or deletions. For example, the isolated polypeptide can comprise an amino acid sequence selected from the group consisting of SEQ ID NO: 2, SEQ ID NO: 4, SEQ ID NO: 12, and SEQ ID NO: 18, wherein the amino acid sequence comprises one or more (e.g., about 1, about 2, about 3, about 4, about 5, about 10, about 15, about 20, about 25, about 30, about 35, about 40, about 45, or about 50) amino acid substitutions, additions, insertions, or deletions.

The invention provides polypeptides comprising biological activity. The biological activity of the polypeptide can be Claisen condensation activity. Specifically, the biological activity of the polypeptide can be the condensation of two acylthioesters.

The invention provides an isolated polypeptide comprising, consisting essentially of, or consisting of, an amino acid sequence encoding OleD which comprises one or more (e.g., about 1, about 2, about 3, about 4, about 5, about 10, about 15, about 20, about 25, about 30, about 35, about 40, about 45, or about 50) amino acid substitutions, additions, insertions, or deletions. For example, the isolated polypeptide comprises an amino acid sequence selected from the group consisting of SEQ ID NO: 8, SEQ ID NO: 16, and SEQ ID NO: 22, wherein the amino acid sequence comprises one or more (e.g., about 1, about 2, about 3, about 4, about 5, about 10, about 15, about 20, about 25, about 30, about 35, about 40, about 45, or about 50) amino acid substitutions, additions, insertions, or deletions.

The invention provides an isolated nucleic acid encoding a polypeptide having the same biological activity as an OleA protein. For example, the invention provides an isolated nucleic acid encoding a polypeptide having the same biological activity as a polypeptide comprising, consisting essentially of, or consisting of, the amino acid sequence selected from the group consisting of SEQ ID NO: 2, SEQ ID NO: 4, SEQ ID NO: 8, SEQ ID NO: 12, SEQ ID NO: 16, SEQ ID NO: 18, and SEQ ID NO: 22. Preferably, the isolated nucleic acid can comprise (i) a nucleic acid sequence selected from the group consisting of SEQ ID NO: 1, SEQ ID NO: 3, SEQ ID NO: 7, SEQ ID NO: 11, SEQ ID NO: 15, SEQ ID NO: 17, and SEQ ID NO: 21 or a fragment thereof, or (ii) a nucleic acid sequence that hybridizes to a complement of a nucleic acid sequence selected from the group consisting of SEQ ID NO: 1, SEQ ID NO: 3, SEQ ID NO: 7, SEQ ID NO: 11, SEQ ID NO: 15, SEQ ID NO: 17, and SEQ ID NO: 21 or to a fragment thereof.

Guidance for performing hybridization reactions can be found in Current Protocols in Molecular Biology, John Wiley & Sons, N.Y. (1989), 6.3.1-6.3.6. Aqueous and non-aqueous methods are described in that reference and either method can be used. Specific hybridization conditions referred to herein are as follows: 1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); 2) medium stringency hybridization conditions in 6×SSC at about 45° C., followed by one or more washes in 0.2×SSC, 0.1% SDS at 60° C.; 3) high stringency hybridization conditions in 6×SSC at about 45° C., followed by one or more washes in 0.2×SSC, 0.1% SDS at 65° C.; and preferably 4) very high stringency hybridization conditions are 0.5M sodium phosphate, 7% SDS at 65° C., followed by one or more washes at 0.2×SSC, 1% SDS at 65° C. Very high stringency conditions (4) are the preferred conditions unless otherwise specified. As used herein, the term "hybridizes" generally refers to low stringency, medium stringency, high stringency, or very high stringency conditions.

The invention provides polypeptides comprising biological activity. The biological activity can be oxidoreductase activity. Specifically, the biological activity can be reduction of a keto-group (e.g., a ketone, aliphatic ketone, α-alkyl-β-keto acid, α-alkyl-β-keto ester).

Hydrocarbon synthase activity is the activity of one or more peptides that causes the conversion of a substrate containing a fatty acyl chain, such as acyl-CoA, acyl-ACP, or fatty acid, to a hydrocarbon or hydrocarbon intermediate. Examples of peptides having hydrocarbon synthase activity include Ole A, Ole B, OleC, OleD, and OleBC.

Hydrocarbon synthase activity can be tested, for example, using a complementation assay (see Example 6, below). Organisms that are known to make hydrocarbons upon the expression of OleA, OleB, OleC, and OleD can be used as a test host. For example, if a candidate OleC is being tested for hydrocarbon synthase activity, then the test host is engineered to express only oleA and oleD, but not oleC. The candidate oleC is then expressed in the test host which lacks oleC. The candidate OleC is deemed to have hydrocarbon synthase activity if the test host produces hydrocarbons.

Using the OleA, OleBC or OleC, and OleD sequences provided herein and the complementation assay described in Example 6, additional hydrocarbon and hydrocarbon intermediate-forming genes can be identified. Hydrocarbons and intermediates thereof can be formed by expressing OleA, OleBC or OleC, and OleD in *E. coli*. Therefore, *E. coli* engineered to make hydrocarbons or other organisms that naturally produce hydrocarbons (e.g., *S. maltophilia*, *C. aggregans*, *X. axonopodis*, or *A. aurescens*) can be used to determine the hydrocarbon synthase activity of a specific DNA sequence or protein when that specific DNA sequence to be tested is not expressed in the host cell.

As used herein, a "host cell" is a cell used to produce a product described herein (e.g., an olefin described herein). A host cell can be modified to express or overexpress selected genes or to have attenuated expression of selected genes.

As an example, when the DNA sequence to be tested encodes a homolog of an OleA protein sequence, it is expressed in a host that is already expressing the oleC and oleD sequences, but not the oleA sequences. The homolog of OleA is deemed to be active (i.e., has hydrocarbon synthase activity) if the host produces hydrocarbons or hydrocarbon intermediates when expressing the homolog of oleA.

The invention provides a method for identifying an enzyme useful for the production of hydrocarbons comprising (i) transforming a cell comprising polypeptides selected from the group consisting of (a) OleA and OleD, (b) OleA and OleC, and (c) OleC and OleD with a nucleic acid encoding an enzyme suspected of having the ability to produce hydrocarbons; and (ii) determining whether the cell produces hydrocarbons, wherein the existence of hydrocarbon production by the cell indicates that the nucleic acid encodes a polypeptide useful for the production of hydrocarbons.

For example, the method can comprise (i) transforming a cell comprising polypeptides selected from the group consisting of (a) OleA and OleD, (b) OleA and OleC, (c) OleC and OleD, (d) OleA and OleBC, and (e) OleBC and OleD with a nucleic acid encoding an enzyme suspected of having the ability to produce hydrocarbons, wherein the OleA shares at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with SEQ ID NO: 2, SEQ ID NO: 4, SEQ ID NO: 12, or SEQ ID NO: 18; wherein the OleC shares at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with SEQ ID NO: 6, SEQ ID NO: 14, SEQ ID NO: 20, or SEQ ID NO: 88; and wherein the OleD shares at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity with SEQ ID NO: 8, SEQ ID NO: 16, or SEQ ID NO: 22, with a nucleic acid encoding an enzyme suspected of having the ability to produce hydrocarbons; and (ii) determining whether the cell produces hydrocarbons, wherein the existence of hydrocarbon production by the cell indicates that the nucleic acid encodes a polypeptide useful for the production of hydrocarbons.

Organisms that produce hydrocarbons naturally (without genetic engineering) can be engineered to overproduce hydrocarbons or produce hydrocarbon with specific carbon chain characteristics by altering the fatty acid biosynthetic pathway as described herein. Exemplary organisms that are known to produce hydrocarbons and can be engineered to alter hydrocarbon production using the teachings provided herein include, but are not limited to, *Acinetobacter* spp., *Chloroflexus* spp., *Kineococcus radiotolerans*, *Stenotrophomonas maltophilia*, *Micrococcus* spp., *Arthrobacter* spp., *Vibrio furnissii*, and cyanobacteria. These genetically engineered recombinant organisms are useful for producing hydrocarbons.

Genetically engineered recombinant organisms also can be used to produce aliphatic ketones. For example, organisms having oleA, oleC, and oleD can be engineered to produce aliphatic ketones by deleting or attenuating genes encoding oleC and oleD. The resulting genetically engineered organism produces ketones as a result of the expression of endogenous oleA when oleC and oleD are deleted or attenuated. Organisms having oleA and oleC can be engineered to produce aliphatic ketones by deleting or attenuating the gene encoding oleC. Similarly, organisms having oleA and oleD can be engineered to produce aliphatic ketones by deleting or attenuating the gene encoding oleD. The resulting genetically engineered organism produces ketones as a result of the expression of endogenous oleA when oleC or oleD is deleted or attenuated.

In other examples, recombinant organisms that produce hydrocarbons are engineered to overexpresses one or more peptides selected from OleA, OleB, OleC, OleD, OleBC, and combinations thereof. These genes can be overexpressed in organisms that naturally produce hydrocarbons, such as those described above, or they can be overexpressed in organisms that do not naturally produce hydrocarbons.

As used herein, "overexpress" means to express or cause to be expressed a nucleic acid, polypeptide, or hydrocarbon in a cell at a greater concentration than is normally expressed in a corresponding wild-type cell. For example, a polypeptide can be "overexpressed" in a recombinant cell when the polypeptide is present in a greater concentration in the recombinant cell compared to its concentration in a non-recombinant cell of the same species.

Examples of recombinant organisms that overexpress a peptide include organisms that express nucleic acids encoding OleA, OleB, OleC, OleD, OleBC, or combinations thereof. Other examples include organisms that have had exogenous promoter sequences introduced upstream of the endogenous coding sequence of OleA, OleB, OleC, OleD, OleBC, or combinations thereof. In some examples, overexpression of one or more fatty acid biosynthetic pathway altering genes can be overexpressed in combination with OleA, OleB, OleC, OleBC, or OleD.

Recombinant organisms (for instance, bacterial, fungal or eukaryotic cells) are provided that are genetically engineered (for instance, transformed, transduced, or transfected) with one or more nucleic acid molecules encoding one or more of OleA (e.g., SEQ ID NO: 2, SEQ ID NO: 4, SEQ ID NO: 12, and SEQ ID NO: 18), OleB (e.g., SEQ ID NO: 10), OleC (e.g., SEQ ID NO: 6, SEQ ID NO: 14, SEQ ID NO: 20, and SEQ ID NO: 88), OleD (e.g., SEQ ID NO: 8, SEQ ID NO: 16, and SEQ ID NO: 22), or a variant or homolog of one or more of these sequences. These sequences can be expressed from vector constructs, directly from the chromosome after gene integration or from extrachromosomal arrays. For example, an OleA (e.g., SEQ ID NO: 2), OleC (e.g., SEQ ID NO: 6), or OleD (e.g., SEQ ID NO: 8) protein is encoded by a nucleic acid that is operably linked to gene expression control elements that are functional in the desired recombinant organism, for instance a T7 promoter in *E. coli*.

As used herein, "control element" means a transcriptional control element. Control elements include promoters and enhancers. The term "promoter element," "promoter," or "promoter sequence" refers to a DNA sequence that functions as a switch that activates the expression of a gene. If the gene is activated, it is said to be transcribed or participating in transcription. Transcription involves the synthesis of mRNA from the gene. A promoter, therefore, serves as a transcriptional regulatory element and also provides a site for initiation of transcription of the gene into mRNA. Control elements interact specifically with cellular proteins involved in transcription (Maniatis et al., *Science* 236: 1237 (1987)).

Methods of expressing proteins in heterologous expression systems are well known in the art. Typically, a bacterial or yeast recombinant organism is transformed by natural transformation, electroporation, conjugation, or transduction. The resulting expression construct can be either extrachromosomal, as with a plasmid, or integrated into the chromosome after recombination. In eukaryotic cells, typically, a recombinant organism is transfected with (or infected with a virus containing) an expression vector using any method suitable for the particular recombinant organism. Such transfection methods are also well known in the art and non-limiting exemplary methods are described herein. The transformed recombinant organism is capable of expressing the protein encoded by the nucleic acid in the expression cassette. In another embodiment, transient or stable transfection of the recombinant organism with one or more expression vectors could also be performed.

Many different types of recombinant organisms can be used to produce the proteins provided herein, such as bacteria, yeasts, algae, fungi, insects, vertebrate cells (such as mammalian cells), and plant cells, including (as appropriate) primary cells and immortal cell lines. Numerous representatives of each cell type are commonly used and are available from a wide variety of commercial sources, including, for example, ATCC, Pharmacia, and Invitrogen.

Various yeast strains and yeast derived vectors are used commonly for the production of heterologous proteins. For instance, specific, non-limiting examples of suitable yeast cells include *Saccharomyces cerevisiae* cells, *Aspergillus* cells, *Trichoderma* cells, *Neurospora* cells, *Fusarium* cells, or *Chrysosporium* cells. In one specific, non-limiting example, *Pichia pastoris* expression systems, obtained from Invitrogen (Carlsbad, Calif.), can be used to produce an OleA, OleB, OleC, OleBC, or OleD peptide. Such systems include suitable *Pichia pastoris* strains, vectors, reagents, transformants, sequencing primers, and media. For example, available strains include, but are not limited to, KM71H (a prototrophic strain), SMD1168H (a prototrophic strain), and SMD1168 (a pep4 mutant strain) (Invitrogen).

*Saccharomyces cerevisiae* is another species of yeast commonly used as a host. The plasmid YRp7 (Stinchcomb et al., *Nature,* 282: 39, (1979); Kingsman et al., *Gene,* 7: 141, (1979); Tschemper et al., *Gene,* 10: 157, (1980)) is commonly used as an expression vector in a mutant *Saccharomyces* which cannot produce tryptophan. This plasmid contains the trp1 gene which when transformed into the mutant strain of yeast allows the mutant strain of yeast to produce tryptophan and grow in the absence of tryptophan. Examples of host strains where the trp1 gene can be used as a selection marker include, but are not limited to, ATCC No. 44,076 and PEP4-1 (Jones, *Genetics,* 23: 12, (1977)). The presence of the trp1 lesion in the yeast recombinant organism genome provides an effective characteristic for detecting transformation by growth in the absence of tryptophan.

Yeast recombinant organisms can be transformed using the polyethylene glycol method, as described by Hinnen, *Proc. Natl. Acad. Sci. USA,* 75: 1929, (1978). Additional yeast transformation protocols are set forth in Gietz et al., *Nucl. Acids Res.,* 20(17): 1425, (1992) and Reeves et al., *FEMS,* 99(2-3): 193-197, (1992).

Many cellular organisms, such as yeast, animals, and bacteria, produce lipids as essential components of their cell membranes. The methods by which these organism produce the fatty acyl groups used as lipids are highly conserved. Nevertheless, there are variations in the pathways that can influence the availability of some of the lipid intermediates, such as acyl-coA and acyl-ACP. These lipid intermediates are also key substrates in the production of aliphatic ketones and hydrocarbons by the Ole proteins. In *Saccharomyces cerevisiae*, acyl-coA is bound to an acyl-coenzyme A-binding protein (ACBP), which protects the acyl-coA's from hydrolysis by thioesterases (see, e.g., Rose et al., *PNAS*, 89: 11287-11291 (1992), Feddersen et al., *Biochem. J.*, 407: 219-230 (2007)). The Ole proteins would compete with the ACBP for acyl-coA to use as a substrate for hydrocarbon or aliphatic ketone synthesis. Therefore, modifications to ACBP may be necessary to reduce its competition for acyl-CoA. Conditional mutations in the ACBP have been shown in the literature to release pools of acyl-CoA in *S. cerevisiae* (see, e.g., Gaigg et al., *Mol. Biol. Cell*, 12: 1147-1160 (2001)). Therefore, expression of the ole genes in a host strain in which there is control over the amount of free acyl-CoA available, such as the *S. cerevisiae* Y700pGAL1-ACB1 strain (see, e.g., Gaigg et al., supra), should lead to higher levels of aliphatic ketones or hydrocarbons produced.

In the construction of suitable expression vectors, the termination sequences associated with these genes are also ligated into the 3' region of the sequence desired to be expressed. Any plasmid vector containing a yeast-compatible promoter capable of transcribing a nucleic acid sequence encoding a prokaryotic tRNA, an origin of replication, and a termination sequence, is suitable.

Other suitable recombinant organisms are bacterial cells. Specific, non-limiting examples of suitable bacterial phyla which could be recombinant organisms include *Acidobacteria, Actinobacteria, Aquificae, Bacteroidetes, Chlamydiae, Chlorobi, Chloroflexi Chrysiogenetes, Cyanobacteria, Deferribacteres, Deinococcus, Thermus, Dictyoglomi, Fibrobacteres, Firmicutes, Fusobacteria, Gemmatimonadetes, Lentisphaerae, Nitrospira, Planctomycetes, Proteobacteria, Spirochaetes, Tenericutes, Thermodesulfobacteria, Thermomicrobia, Thermotogae*, and *Verrucomicrobia*.

Specific, non-limiting examples of bacterial species which could be used as recombinant organisms include *Escherichia coli, Thermus thermophilus, Stenotrophomonas maltophilia, Kineococcus radiotolerans, Bacillus stearothermophilus, Methanococcus jannaschii, Methanosarcina mazei, Methanobacterium thermoautotrophicum, Methanococcus maripaludis, Methanopyrus kandleri, Halobacterium* such as *Haloferax volcanii* and *Halobacterium* species NRC-i, *Archaeoglobus fulgidus, Pyrococcus fit riosus, Pyrococcus horikoshii, Pyrobaculum aerophilum, Pyrococcus abyssi, Sulfolobus solfataricus, Sulfolobus tokodaii, Aeuropyrum pernix, Thermoplasma acidophilum*, and *Thermoplasma volcanium*.

In one embodiment, the recombinant organism is an *E. coli* cell, a *S. maltophilia* cell, a *Pseudomonas* sp. cell, a *Bacillus* sp. cell, an *Actinomycetes* cell or cells belonging to the genus *Rhodococcus*. Introduction of the construct into the recombinant organism can be accomplished by a variety of methods including, but not limited to, calcium phosphate transfection, DEAE-dextran mediated transfection, polybrene mediated transfection, protoplast fusion, liposome mediated transfection, conjugation, natural transformation, electroporation, and other methods known in the art.

Still other suitable recombinant organisms are plant cells (e.g., club mosses, ferns, angiosperms, or gymnosperms). Additional suitable recombinant organisms include, but not limited to, algae, mosses, and lichens. Any known method can be employed for plant cell transformation, culture, and regeneration can be employed. Methods for introduction of foreign DNA into plant cells include, but are not limited to, transfer involving the use of *Agrobacterium tumefaciens* and appropriate Ti vectors, including binary vectors; chemically induced transfer (for instance, with polyethylene glycol); biolistics; and microinjection. See, for instance, An et al., *Plant Molecular Biology Manual, A*3: 1-19 (1988). Various promoters suitable for expression of heterologous genes in plant cells are known in the art, including constitutive promoters, for example the cauliflower mosaic virus (CaMV) 35S promoter, which is expressed in many plant tissues, organ- or tissue-specific promoters, and promoters that are inducible by chemicals, such as methyl jasminate, salicylic acid, or safeners.

Recombinant organisms are grown under appropriate conditions to a suitable cell density. If the sequence of interest is operably linked to an inducible promoter, the appropriate environmental alteration is made to induce expression. If the product (e.g., hydrocarbon) accumulates in the recombinant organism, the cells are harvested, for example, by centrifugation or filtration. Whole cell extractions can be performed to purify the products from the whole cells. In an alternate embodiment, a whole culture extraction, wherein the organism, medium, and product are collected together, could be performed to recover the desired product. The whole culture extract can then be purified to obtain the desired product. If the recombinant organisms secrete the product into the medium, the cells and medium are separated. The medium is then retained for purification of the desired product.

The invention provides a genetically engineered organism comprising an exogenous nucleic acid sequence stably incorporated into the genome of an organism upstream of a genomic nucleic acid sequence that (a) has at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity to the nucleic acid sequence of an ole gene and (b) encodes a polypeptide. For example, the genetically engineered organism can comprise an exogenous nucleic acid sequence stably incorporated into the genome of an organism upstream of a genomic nucleic acid sequence that has at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity to a nucleic acid sequence selected from the group consisting of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 87, and a nucleic acid sequence encoding any of SEQ ID NOs: 135-464. Preferably, the genetically engineered organism can comprise an exogenous nucleic acid sequence stably incorporated into the genome of an organism upstream of a genomic nucleic acid sequence that has at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity to a nucleic acid sequence selected from the group consisting of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, and SEQ ID NO: 87.

In a preferred embodiment, the genetically engineered organism comprises an exogenous nucleic acid sequence stably incorporated into the genome of an organism upstream of a genomic nucleic acid sequence comprising, consisting essentially of or consisting of, a nucleic acid sequence selected from the group consisting of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, and SEQ ID NO: 87.

The invention also provides a genetically engineered organism prepared by (a) providing an organism having a nucleic acid sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity to the nucleic acid sequence of an ole gene and (b) deleting or mutating the nucleic acid sequence. For example, the genetically engineered organism is prepared by deleting or mutating a nucleic acid sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity to a nucleic acid sequence selected from the group consisting of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 87, and a nucleic acid sequence encoding any of SEQ ID NOs: 135-464. Preferably, the genetically engineered organism is prepared by deleting or mutating a nucleic acid sequence having at least about 35% (e.g., at least about 45%, at least about 50%, at least about 60%, at least about 70%, at least about 80%, at least about 85%, at least about 90%, at least about 95%, at least about 96%, at least about 97%, at least about 98%, at least about 99%, or at least about 99.5%) sequence identity to a nucleic acid sequence selected from the group consisting of SEQ ID NO: 5, SEQ ID NO: 7, SEQ ID NO: 13, SEQ ID NO: 15, SEQ ID NO: 19, SEQ ID NO: 21, and SEQ ID NO: 87.

In a preferred embodiment, the genetically engineered organism is prepared by deleting or mutating a nucleic acid sequence comprising, consisting essentially of, or consisting of, a nucleic acid sequence selected from the group consisting of SEQ ID NO: 5, SEQ ID NO: 7, SEQ ID NO: 13, SEQ ID NO: 15, SEQ ID NO: 19, SEQ ID NO: 21, and SEQ ID NO: 87.

The genetically engineered organism can be any organism amenable to genetic engineering. Preferably, the genetically engineered organism is selected from the group consisting of *Anaeromyxobacter* sp. Fw109-5, *Arthrobacter aurescens*, *Arthrobacter* chlorophenolicus, *Arthrobacter* sp. FB24, *Bdellovibrio bacteriovorus*, *Blastopirellula marina*, *Brevibacterium linens*, *Burkholderia ambifaria*, *Burkholderia cenocepacia*, *Burkholderia oklahomensis*, *Burkholderia pseudomallei*, *Burkholderia* sp. 383, *Candidatus Kuenenia stuttgartiensis*, *Chloroflexus aggregans*, *Chloroflexus aurantiacus*, *Clavibacter michiganensis* subsp. *michiganensis*, *Clavibacter michiganensis* subsp. *Sepedonicus*, *Clostridium botulinum* A, *Clostridium botulinum* A3, *Clostridium botulinum* B1, *Clostridium botulinum* Bf, *Clostridium botulinum* F, *Clostridium botulinum*, *Colwellia psychrerythraea*, *Congregibacter litoralis*, *Desulfatibacillum alkenivorans*, *Desulfococcus oleovorans*, *Desulfotalea psychrophila*, *Desulfuromonas acetoxidans*, *Flavobacteriales bacterium*, *Gemmata obscuriglobus*, *Geobacter bemidjiensis*, *Geobacter lovleyi*, *Geobacter* sp. FRC-32, *Geobacter uraniumreducens*, *Hahella chejuensis*, *Jannaschia* sp. CCS1, *Kineococcus radiotolerans*, *Lentisphaera araneosa*, *Maricaulis maris*, *Marinobacter algicola*, *Marinobacter aquaeolei*, *Micrococcus luteus*, *Microscilla marina*, *Moritella* sp. PE36, *Mycobacterium avium*, *Mycobacterium avium* subsp. *paratuberculosis*, *Mycobacterium marinum*, *Mycobacterium* sp. GP1, *Mycobacterium tuberculosis*, *Mycobacterium vanbaalenii*, *Neisseria gonorrhoeae*, *Nocardia farcinica*, *Opitutaceae bacterium*, *Opitutus terrae*, *Paenibacillus* sp. JDR-2, *Pelobacter propionicus*, *Photobacterium profundum*, *Photobacterium profundum*, *Photorhabdus luminescens* subsp. *laumondii*, *Planctomyces maxis*, *Plesiocystis pacifica*, *Pseudoalteromonas atlantica*, *Psychromonas ingrahamii*, *Psychromonas* sp. CNPT3, *Ralstonia pickettii*, *Rhodococcus rhodochrous*, *Rhodococcus* sp., *Rhodopirellula baltica*, *Roseovarius nubinhibens*, *Shewanella amazonensis*, *Shewanella baltica*, *Shewanella benthica*, *Shewanella denitrificans*, *Shewanella frigidimarina*, *Shewanella halifaxensis*, *Shewanella loihica*, *Shewanella oneidensis*, *Shewanella pealeana*, *Shewanella putrefaciens*, *Shewanella sediminis*, *Shewanella* sp. ANA-3, *Shewanella* sp. MR-4, *Shewanella* sp. MR-7, *Shewanella* sp. W3-18-1, *Shewanella woodyi*, *Stenotrophomonas maltophilia*, *Streptomyces ambofaciens*, *Xanthomonas axonopodis*, *Xanthomonas campestris*, *Xanthomonas oryzae*, and *Xylella fastidiosa*.

In a preferred embodiment, the exogenous nucleic acid sequence stably incorporated into the genome of a genetically engineered organism increases the expression of the polypeptide encoded by the genomic nucleic acid sequence relative to the expression of the same polypeptide in the organism prior to the incorporation of the exogenous nucleic acid sequence under the same conditions. Preferably, the genetically engineered organism produces an increased amount of a hydrocarbon relative to the production of a hydrocarbon in a wild-type organism under the same conditions.

In a preferred embodiment, the deletion or mutation of the nucleic acid sequence in the genetically engineered organism results in a decreased production of a polypeptide encoded by the nucleic acid sequence relative to the production of the same polypeptide in the organism prior to deletion or mutation of the nucleic acid sequence under the same conditions. Preferably, the genetically engineered organism produces ketones. For example, the genetically engineered organism can produce an increased amount of ketones relative to the production of ketones in the organism prior to deletion or mutation of the nucleic acid sequence under the same conditions.

The invention provides methods of making aliphatic ketones, hydrocarbons, and intermediates thereof. Various recombinant organisms are provided that can be used to produce products having engineered carbon chain lengths, site of unsaturation, and branch points. Methods of making such products are also provided as well as methods of further modifying the products, such as through cracking, to create high quality biofuels and specialty chemicals.

The aliphatic ketones, hydrocarbons, and hydrocarbon intermediates can be engineered to have specific carbon chain characteristics by expressing various enzymes or attenuating the expression of various enzymes in the recombinant organism. For example, carbon chain length can be controlled by expressing various thioesterases in the recombinant organism while attenuating the expression of endogenous thioesterases. Similarly, various branch points can be introduced into the carbon chain by expressing various branched chain α-ketoacid decarboxylase/dehydrogenase genes (e.g., bkd genes), and the degree of saturation can also be controlled by expressing various genes, for example, by overexpressing β-keto-ACP-synthase genes (e.g., fabB). A detailed description of the various modifications which can be included in a recombinant organism to provide specific carbon chain characteristics and to increase fatty acid biosynthetic pathway production is provided in the International Patent Application Publication WO 2007/136762, which is herein incorporated in its entirety by reference.

The invention provides a method for producing biofuels comprising any of the methods described herein. As used therein, the term "biofuel" refers to any fuel derived from biomass. Biofuels can be substituted for petroleum based fuels. For example, biofuels are inclusive of transportation fuels (e.g., gasoline, diesel, jet fuel, etc.), heating fuels, and electricity-generating fuels. Biofuels are a renewable energy source. Specifically, the biofuel produced can be a gasoline, biodiesel, or jet fuel.

Biofuels comprising biologically produced hydrocarbons, particularly hydrocarbons biologically produced using the fatty acid biosynthetic pathway, have not been produced from renewable sources and, as such, are new compositions of matter. These new fuels can be distinguished from fuels derived from petrochemical carbon on the basis of dual carbon-isotopic fingerprinting or $^{14}C$ dating. Additionally, the specific source of biosourced carbon (e.g., glucose vs. glycerol) can be determined by dual carbon-isotopic fingerprinting (see U.S. Pat. No. 7,169,588, which is herein incorporated by reference).

The ability to distinguish biofuels from petroleum based fuels is beneficial in tracking these materials in commerce. For example, fuels or chemicals comprising both biologically based and petroleum based carbon isotope profiles may be distinguished from fuels and chemicals made only of petroleum based materials. Hence, the instant materials may be followed in commerce on the basis of their unique carbon isotope profile.

Biofuels can be distinguished from petroleum based fuels by comparing the stable carbon isotope ratio ($^{13}C/^{12}C$) in each fuel. The $^{13}C/^{12}C$ ratio in a given biologically based material is a consequence of the $^{13}C/^{12}C$ ratio in atmospheric carbon dioxide at the time the carbon dioxide is fixed. It also reflects the precise metabolic pathway. Regional variations also occur. Petroleum, $C_3$ plants (the broadleaf), $C_4$ plants (the grasses), and marine carbonates all show significant differences in $^{13}C/^{12}C$ and the corresponding $\delta^{13}C$ values. Furthermore, lipid matter of $C_3$ and $C_4$ plants analyze differently than materials derived from the carbohydrate components of the same plants as a consequence of the metabolic pathway.

Within the precision of measurement, $^{13}C$ shows large variations due to isotopic fractionation effects, the most significant of which for biofuels is the photosynthetic mechanism. The major cause of differences in the carbon isotope ratio in plants is closely associated with differences in the pathway of photosynthetic carbon metabolism in the plants, particularly the reaction occurring during the primary carboxylation (i.e., the initial fixation of atmospheric $CO_2$). Two large classes of vegetation are those that incorporate the "$C_3$" (or Calvin-Benson) photosynthetic cycle and those that incorporate the "$C_4$" (or Hatch-Slack) photosynthetic cycle.

In $C_3$ plants, the primary $CO_2$ fixation or carboxylation reaction involves the enzyme ribulose-1,5-diphosphate carboxylase and the first stable product is a 3-carbon compound. $C_3$ plants, such as hardwoods and conifers, are dominant in the temperate climate zones.

In $C_4$ plants, an additional carboxylation reaction involving another enzyme, phosphoenol-pyruvate carboxylase, is the primary carboxylation reaction. The first stable carbon compound is a 4-carbon acid which is subsequently decarboxylated. The $CO_2$ thus released is refixed by the $C_3$ cycle. Examples of $C_4$ plants are tropical grasses, corn, and sugar cane.

Both $C_4$ and $C_3$ plants exhibit a range of $^{13}C/^{12}C$ isotopic ratios, but typical values are about −7 to about −13 per mil for $C_4$ plants and about −19 to about −27 per mil for $C_3$ plants (see, e.g., Stuiver et al., Radiocarbon, 19: 355 (1977)). Coal and petroleum fall generally in this latter range. The $^{13}C$ measurement scale was originally defined by a zero set by Pee Dee Belemnite (PDB) limestone, where values are given in parts per thousand deviations from this material. The "$\delta^{13}C$", values are in parts per thousand (per mil), abbreviated, ‰, and are calculated as follows:

$$\delta^{13}C(‰)=[(^{13}C/^{12}C)_{sample}-(^{13}C/^{12}C)_{standard}]/(^{13}C/^{12}C)_{standard}\times 1000$$

Since the PDB reference material (RM) has been exhausted, a series of alternative RMs have been developed in cooperation with the IAEA, USGS, NIST, and other selected international isotope laboratories. Notations for the per mil deviations from PDB is $\delta^{13}C$. Measurements are made on $CO_2$ by high precision stable ratio mass spectrometry (IRMS) on molecular ions of masses 44, 45, and 46.

The invention provides a hydrocarbon or biofuel produced by any of the methods disclosed herein. Specifically, the hydrocarbon or biofuel can have a $\delta^{13}C$ of about −28 or greater, about −27 or greater, −20 or greater, −18 or greater, −15 or greater, −13 or greater, −10 or greater, and −8 or greater. For example, the hydrocarbon can have a $\delta^{13}C$ of about −30 to about −15, about −27 to about −19, about −25 to about −21, about −15 to about −5, about −13 to about −7, about −13 to about −10. The invention also provides for a hydrocarbon or biofule with a $\delta^{13}C$ of about −10, −11, −12, or −12.3.

Biofuels can also be distinguished from petroleum based fuels by comparing the amount of $^{14}C$ in each fuel. Because $^{14}C$ has a nuclear half life of 5730 years, petroleum based fuels containing "older" carbon can be distinguished from biofuels which contain "newer" carbon (see, e.g., Currie, "Source Apportionment of Atmospheric Particles," Characterization of Environmental Particles, J. Buffle and H. P. van Leeuwen, Eds., 1 of Vol. I of the IUPAC Environmental Analytical Chemistry Series (Lewis Publishers, Inc) (1992) 3-74).

The basic assumption in radiocarbon dating is that the constancy of $^{14}C$ concentration in the atmosphere leads to the constancy of $^{14}C$ in living organisms. However, because of atmospheric nuclear testing since 1950 and the burning of fossil fuel since 1850, $^{14}C$ has acquired a second, geochemical time characteristic. Its concentration in atmospheric $CO_2$, and hence in the living biosphere, approximately doubled at the peak of nuclear testing, in the mid-1960s. It has since been gradually returning to the steady-state cosmogenic (atmospheric) baseline isotope rate ($^{14}C/^{12}C$) of about $1.2\times10^{-12}$, with an approximate relaxation "half-life" of 7-10 years. (This latter half-life must not be taken literally; rather, one must use the detailed atmospheric nuclear input/decay function to trace the variation of atmospheric and biospheric $^{14}C$ since the onset of the nuclear age.)

It is this latter biospheric $^{14}C$ time characteristic that holds out the promise of annual dating of recent biospheric carbon. $^{14}C$ can be measured by accelerator mass spectrometry (AMS), with results given in units of "fraction of modern carbon" ($f_M$). $f_M$ is defined by National Institute of Standards and Technology (NIST) Standard Reference Materials (SRMs) 4990B and 4990C. As used herein, "fraction of modern carbon" or "$f_M$" has the same meaning as defined by National Institute of Standards and Technology (NIST) Standard Reference Materials (SRMs) 4990B and 4990C, known as oxalic acids standards $^{14}C/^{12}C$ HOxI and HOxII, respectively. The fundamental definition relates to 0.95 times the isotope ratio HOxI (referenced to AD 1950). This is roughly equivalent to decay-corrected pre-Industrial Revolution wood. For the current living biosphere (plant material), $f_M$ is approximately 1.1.

The invention provides a hydrocarbon or biofuel which can have an $f_M$ $^{14}C$ of at least about 1. For example, the hydrocarbon or biofuel can have an $f_M$ $^{14}C$ of at least about 1.01, an $f_M$ $^{14}C$ of about 1 to about 1.5, an $f_M$ $^{14}C$ of about 1.04 to about 1.18, or an $f_M$ $^{14}C$ of about 1.111 to about 1.124.

Another measurement of $^{14}C$ is known as the percent of modern carbon, pMC. For an archaeologist or geologist using $^{14}C$ dates, AD 1950 equals "zero years old". This also represents 100 pMC. "Bomb carbon" in the atmosphere reached almost twice the normal level in 1963 at the peak of thermonuclear weapons. Its distribution within the atmosphere has been approximated since its appearance, showing values that are greater than 100 pMC for plants and animals living since AD 1950. It has gradually decreased over time with today's value being near 107.5 pMC. This means that a fresh biomass material, such as corn, would give a $^{14}C$ signature near 107.5 pMC. Petroleum based compounds will have a pMC value of zero. Combining fossil carbon with present day carbon will result in a dilution of the present day pMC content. By presuming 107.5 pMC represents the $^{14}C$ content of present day biomass materials and 0 pMC represents the $^{14}C$ content of petroleum based products, the measured pMC value for that material will reflect the proportions of the two component types. For example, a material derived 100% from present day soybeans would give a radiocarbon signature near 107.5 pMC. If that material was diluted 50% with petroleum based products, it would give a radiocarbon signature of approximately 54 pMC.

A biologically based carbon content is derived by assigning 100% equal to 107.5 pMC and 0% equal to 0 pMC. For example, a sample measuring 99 pMC will give an equivalent biologically based carbon content of 93%. This value is referred to as the mean biologically based carbon result and assumes all the components within the analyzed material originated either from present day biological material or petroleum based material.

The invention provides a hydrocarbon or biofuel which can have a pMC of at least about 50, 60, 70, 75, 80, 85, 90, 95, 96, 97, 98, 99, or 100. The invention further provides for a hydrocarbon or fuel which has a pMC of between about 50 to about 100, about 60 to about 100, about 70 to about 100, about 80 to about 100, about 85 to about 100, and about 87 to about 98, about 90 to about 95. The invention further provides for a hydrocarbon or biofuel with a pMC of about 90, 91, 92, 93, 94, or 94.2.

The hydrocarbon can be an olefin. The olefin can be monounsaturated or polyunsaturated (e.g., diunsaturated, triunsaturated, etc.). The olefin can have a carbon chain length of between about 10 to about 40 carbons. For example, the olefin can have a carbon chain length of between about 15 to about 35, about 17 to about 34, 18 to about 33, about 19 to about 33 carbons, between about 27 to about 33 hydrocarbons, between about 29 to about 31 hydrocarbons, or about 27, 28, 29, 30, 31, 32, or 33 hydrocarbons. The hydrocarbon can be a straight chain hydrocarbon or a branched chain hydrocarbon. The hydrocarbon can comprise a cyclic moiety.

The invention provides a biofuel comprising the hydrocarbons disclosed herein. The biofuel can be gasoline, biodiesel, or jet fuel. The biofuel can be derived from a carbon source. As used herein, the phrase "carbon source" refers to a substrate or compound suitable to be used as a source of carbon for prokaryotic or simple eukaryotic cell growth. Carbon sources can be in various forms, including, but not limited to polymers, carbohydrates, acids, alcohols, aldehydes, ketones, amino acids, peptides, and gases (e.g., CO and CO2). These include, for example, various monosaccharides, such as glucose, fructose, mannose, and galactose; oligosaccharides, such as fructo-oligosaccharide and galacto-oligosaccharide; polysaccharides such as xylose and arabinose; disaccharides, such as sucrose, maltose, and turanose; cellulosic material, such as methyl cellulose and sodium carboxymethyl cellulose; saturated or unsaturated fatty acid esters, such as succinate, lactate, and acetate; alcohols, such as ethanol or mixtures thereof. The carbon source can also be a product of photosynthesis, including, but not limited to, glucose.

A preferred carbon source is biomass. As used herein, the term "biomass" refers to a carbon source derived from biological material. Biomass can be converted into a biofuel. One exemplary source of biomass is plant matter. For example, corn, sugar cane, or switchgrass can be used as biomass. Another non-limiting example of biomass is animal matter, for example cow manure. Biomass also includes waste products from industry, agriculture, forestry, and households. Examples of such waste products that can be used as biomass are fermentation waste, straw, lumber, sewage, garbage, and food leftovers. Biomass also includes sources of carbon, such as carbohydrates (e.g., monosaccharides, disaccharides, or polysaccharides). Another preferred carbon source is glucose. Preferably, the carbon source is a renewable energy source. The renewable energy source can be a biomass.

The following examples further illustrate the invention, but, should not be construed as in any way limiting its scope.

EXAMPLE 1

This example describes materials and methods used in carrying out the examples within this patent. Although particular methods are described, one of ordinary skill in the art will understand that other, similar methods also can be used. In general, standard laboratory practices were used, unless otherwise stipulated. For example, standard laboratory practices were used for: cloning; manipulation and sequencing of nucleic acids; purification and analysis of proteins; and other molecular biological and biochemical techniques. Such techniques are explained in detail in standard laboratory manuals, such as Sambrook et al., supra; and Ausubel et al., supra.

Genome Sequences:

The complete genome sequence of *Stenotrophomonas maltophilia* is available to the public for two different strains. The complete genome sequence for *S. maltophilia* R551-3 can be found at http://genome.ornl.gov/microbial/smal/ (last accessed on May 16, 2007). The complete genome sequence for *S. maltophilia* strain K279a can be found at http://www.sanger.ac.uk/Projects/S_maltophilia/ (last accessed on May 16, 2007). The nucleic acid sequences encoding the proteins described herein are found in both sequenced genomes and were experimentally confirmed in the *S. maltophilia* strain from ATCC 17679. In addition, some of the protein activities were confirmed in *E. coli, B. subtilis, B. megaterium*, and *S. cerevisiae* using nucleic acid sequences and codon optimized nucleic acid sequences as described herein.

Microbial Strains:

The microbial strains used herein were as follows:

*S. maltophilia* (ATCC strain numbers: 17674, 17679, 17445, 17666);

*S. maltophilia* ATCC 17679 ΔoleA

*S. maltophilia* ATCC 17679 ΔoleC

*S. maltophilia* ATCC 17679 ΔoleD
*E. coli* T7 Express lysY/I<sup>q</sup> (New England Biolabs, Ipswich, Mass. 01938-2723)
*E. coli* C41(DE3) (Lucigen Corporation, Middleton, Wis. 53562)
*E. coli* C41(DE3) ΔfadE (the *E. coli* C41(DE3) strain from Lucigen Corporation, Middleton, WI 53562 with a deletion of the fadE gene EC 1.3.99.3, an acyl-CoA dehydrogenase, Klein. K. et al., *Eur. J. Biochem. II I* 19: 442-450 (1971)).
*E. coli* C41(DE3) ΔfadE; pET-21b(+)_OleA, pCOLADuet-1_OleC, pCDFDuet-1_OleD
*E. coli* C41(DE3); pET-21b(+)_OleA
*E. coli* C41(DE3); pET-21b(+)_OleB
*E. coli* C41(DE3); pET-21b(+)_OleD
*E. coli* C41(DE3); pETDuet-1_OleAB; pCOLADuet-1_OleCD
*E. coli* MG1655 ΔfadE (the *E. coli* MG1655 with a deletion of the fadE gene)
*E. coli* MG1655 ΔfadE, fadD (+) (the *E. coli* MG1655 strain with a deletion of the fadE gene and a T5 promoter sequence upstream of fadD)
*Saccharomyces cerevisiae* Hansen, teleomorph BY4741 (ATCC 201388)
*S. cerevisiae* BY4741; pESC-HIS_OleA
*Bacillus megaterium* WH320 (strain from Mo Bi Tec, Germany)
*B. megaterium* WH320; pWH1520_OleCDAB
*B. megaterium* WH320; pWH1520
*Bacillus subtilis* IHA01 lacA::spec leuB8 metB5 r(-)m(+) Sp (strain from *Bacillus* Genetic Stock Center, Columbus, Ohio strain number BGSC 1A785)
*B. subtilis* IHA01, pHT01_OleA
*Arthrobacter aurescens* TC1 (strain from ATCC BAA-1386)

Resistance markers: AmpR, ampicillin/carbenicillin (100 µg/mL); KanR, kanamycin (30 µg/mL); CamR, chloramphenicol (34 µg/mL); SmR, streptomycin/spectinomycin (50 µg/mL); and tetracycline (15 µg/mL *E. coli, B. megaterium*, 50 µg/mL *S. maltophilia*) resistance markers were used in the examples described herein.

Polymerase chain reaction (PCR): PCR was used to amplify the specified nucleic acid sequences from DNA to create many of the expression constructs described herein. The primers used for the PCR reactions described herein are listed in Table 14. The plasmids are listed in Table 15.

TABLE 14

| Name | Sequence 5' to 3' |
|---|---|
| Gene 1: /locus_tag = "OleA" | |
| LB118 | GATACATATGCTCTTCAAGAATGTCTCG (SEQ ID NO: 29) |
| LB119 | TCAGCTCGAGCCAGACCACTTCAGCCATCGAG (SEQ ID NO: 30) |
| Gene 2: /locus_tag = "OleC" | |
| LB155 | GATACATATGAACCGACCCTGCAATATTGC (SEQ ID NO: 31) |
| LB159 | TCAGCTCGAGTCATGCGCGCTTCTCCAGTTCGGCGCTGGC (SEQ ID NO: 32) |

TABLE 14-continued

| Name | Sequence 5' to 3' |
|---|---|
| Gene 3: /locus_tag = "OleD" | |
| LB157 | GATACATATGAAGATCCTGGTCACCGGTGGTGG (SEQ ID NO: 33) |
| LB158 | TCAGCTCGAGCTATGCGGCAGATGAAGCCTTCAG (SEQ ID NO: 34) |
| Gene 4: /locus_tag = "OleB" | |
| LB151 | GATACATATGTCCCAGCTTCCCGGTTACC (SEQ ID NO: 35) |
| LB152 | TCAGCTCGAGTCAGATCGGGTTCTTGTCCAGG (SEQ ID NO: 36) |
| Gene 1 and 4 as an operon | |
| LB118 | GATACATATGCTCTTCAAGAATGTCTCG (SEQ ID NO: 29) |
| LB152 | TCAGCTCGAGTCAGATCGGGTTCTTGTCCAGG (SEQ ID NO: 36) |
| Gene 2 and 3 as an operon | |
| LB155 | GATACATATGAACCGACCCTGCAATATTGC (SEQ ID NO: 31) |
| LB158 | TCAGCTCGAGCTATGCGGCAGATGAAGCCTTCAG (SEQ ID NO: 34) |
| Primers used to clone additional hydrocarbon producing genes | |
| LF305 | GGATACATGTTATTCAAAAATGTATCTATC (SEQ ID NO: 37) |
| LF306 | CTCGAGAAGCTTACCACACAACCTCAGCC (SEQ ID NO: 38) |
| LF307 | GGATACATGTTATTTCAGAATGTTTCTATCGC (SEQ ID NO: 39) |
| LF308 | CTCGAGAAGCTTACCAAACCACTTCGGCCATGCTG (SEQ ID NO: 40) |
| LF313 | GGATACATGTTATTCAAGCACGTCATGATCG (SEQ ID NO: 41) |
| LF314 | CTCGAGAAGCTTACCACGTAACGGACATCATAG (SEQ ID NO: 42) |
| Primers to clone oleA into *S. cerevisiae* expression vector pESC-HIS | |
| LB217 | CAATGGGCCCAAAACAATGCTCTTCAAGAATGTCTCG (SEQ ID NO: 43) |
| LF304 | TCATCTCGAGTTACCAGACCACTTCAGCCATCGAG (SEQ ID NO: 44) |
| Primers to clone oleA into pCL1920pTrc vector | |
| LB189 | GATCACATGTTATTCAAGAATGTCTCGATCG (SEQ ID NO: 45) |
| Primers to clone fadD into the Duet vectors, pCDFDuet-1 or pETDuet-1 | |
| fadD_F | CATGCCATGGTGAAGAAGGTTTGGCTTAA (SEQ ID NO: 46) |
| fadD_R | CCCAAGCTTTCAGGCTTTATTGTCCAC (SEQ ID NO: 47) |

TABLE 14-continued

| Name | Sequence 5' to 3' |
|---|---|
| Primers to replace fadD promoter with T5 promoter | |
| LB284 | TTTTTAAAGAAAAAGAAACAGCGGCTGGTCCGCTGTTT CTGCATTCTTACGGATGCATATGGCGGCCGC (SEQ ID NO: 48) |
| LB285 | AACCTTCTTCAATTCTTCACCTCTAAAATGCGTGTTCG TCGTCATCGCAATTGAATCTATTATAATTGTTATCCGC TCACAAAGCAAATAAATTTTTTATGATTTGTATCGATA AGCTGGATCCA (SEQ ID NO: 49) |
| Primers used to clone thioesterase genes | |
| TesA_F | CATATGGCGGACACGTTATTGATT (SEQ ID NO: 50) |
| TesA_R | CCTAGGTTATGAGTCATGATTTACTAAAG (SEQ ID NO: 51) |
| CcFatB_F | TCTAGAGTCTCGAGACATATGCTCCCAGATTGGAGTAT GTT (SEQ ID NO: 52) |
| CcFatB_R | TCTAGACGCTCTAAGCTTCCTAGGTTAAACGCTACTCT (SEQ ID NO: 53) |
| ChFatB2_F | TCTAGAGTCTCGAGACATATGCTCCCCGATTGGTCCCG (SEQ ID NO: 54) |
| ChFatB2_R | TCTAGACGCTCTAAGCTTCCTAGGTTAAGAGACCGAA TT (SEQ ID NO: 55) |
| UcFatB1_F | TCTAGAGTCTCGAGACATATGCTCCCTGATTGGAGTAT GTTA (SEQ ID NO: 56) |
| UcFatB1_R | TCTAGACGCTCTAAGCTTCCTAGGTTAAACGCGCG (SEQ ID NO: 57) |
| Primers used to make vector constructs used to delete the oleA open reading frame in S. maltophilia | |
| LB200 | GTCAGCGGTGACTTTGTTACCAGACGAAGAGCATC GAGGTTAGCGCCAAG (SEQ ID NO: 58) |
| LB201 | CTTGGCGCTAACCTCGATGCTCTTCGTCTGGTAAC AAAGTCACCGCTGAC (SEQ ID NO: 59) |
| LB202 | GCTCTAGAGGTCAACCGCATCCGCAACATCC (SEQ ID NO: 60) |
| LB203 | CTTCACCTCGCGCCTGAACATGAAC (SEQ ID NO: 61) |
| LB204 | TGACAAGCTTAGCGCGGCCTGGAAGCCCTTCAGG (SEQ ID NO: 62) |
| LB205 | AAGGCCAGCCCGCAGTGCGACAAG (SEQ ID NO: 63) |
| Primers used to make the pCL1920pTrc vector | |
| LF302 | ATATGACGTCGGCATCCGCTTACAGACA (SEQ ID NO: 76) |
| LF303 | AATTCTTAAGTCAGGAGAGCGTTCACCGACAA (SEQ ID NO: 77) |
| Primers used to make pCL1920pTrcOleCDAB | |
| LB270 | AACAACTAATTCAGACATACATC (SEQ ID NO: 79) |

TABLE 14-continued

| Name | Sequence 5' to 3' |
|---|---|
| LB271 | CTTCCGCTAGCTGCCTGACGCCAGAAGCATTGGTGC (SEQ ID NO: 80) |
| LB272 | ATAGGATCCTAAGGAGGAATAAACCATGTTGTTCAAAA ATGTATC (SEQ ID NO: 81) |
| LB275 | TTAAGATCTAGATCGGGTTTTTATCCAGGAACGCACG (SEQ ID NO: 82) |
| Primers used to clone the loxPcat cassette | |
| LB284 | TTTTTAAAGAAAAAGAAACAGCGGCTGGTCCGCTGTTT CTGCATTCTTACGGATGCATATGGCGGCCGC (SEQ ID NO: 83) |
| LB285 | AACCTTCTTCAATTCTTCACCTCTAAAATGCGTGTTCG TCGTCATCGCAATTGAATCTATTATAATTGTTATCCGC TCACAAAGCAAATAAATTTTTTATGATTTGTATCGATA AGCTGGATCCA (SEQ ID NO: 84) |
| Primers used to subclone oleC from Plesiocystis pacifica | |
| LB223 | GCTGAACATGTCTACTGAAGGTGCT (SEQ ID NO: 85) |
| LB224 | TGCAAGCTTACGCAGACGTGCTTCTGC (SEQ ID NO: 86) |
| Primers used to make vector constructs used to delete the oleC open reading frame in S. maltophilia | |
| LB110 | CCGGTGACCAGGATCTTCATGCGCGTCGGTTCATCCGT TCATTGTCGCCG (SEQ ID NO: 465) |
| LB111 | CGGCGACAATGAACGGATGAACCGACGCGCATGAAGAT CCTGGTCACCGG (SEQ ID NO: 466) |
| LB112 | TGTCGCACCACGACCAGGTcAAG (SEQ ID NO: 467) |
| LB113 | CATCTCTAGAACTGGAAGATCGGCGAGTGGATC (SEQ ID NO: 468) |
| LB114 | GCGTAATGCAGCATGGCGCTC (SEQ ID NO: 469) |
| LB115 | TGACAAGCTTTCAGCCTGCGCAGCCCTTCTTC (SEQ ID NO: 470) |
| Primers used to make vector constructs used to delete the oleD open reading frame in S. maltophilia | |
| LB122 | AGCCAGTGACGGCGATCTATGCGGCGATCTTCATGCGC GCTTCTCCAGTT (SEQ ID NO: 472) |
| LB123 | AACTGGAGAAGCGCGCATGAAGATCGCCGCATAGATCG CCGTCACTGGCT (SEQ ID NO: (473)) |
| LB124 | AGGACATGGCCGCGATCCTG (SEQ ID NO: 474) |
| LB125 | CATCTCTAGATGGGCAGCGCCTTCGGCATGG (SEQ ID NO: 475) |
| LB127 | TGACAAGCTTCGGCCAACCAGGGTTCGTCGG (SEQ ID NO: 476) |

TABLE 14-continued

| Name | Sequence 5' to 3' |
|---|---|
| Primers to clone oleA into *B. megaterium* expression vector pWH1520 | |
| LB402 | ATATACTAGTATGAATCGTCCGTGC (SEQ ID NO: 488) |
| LB387 | TATATCTAGACCCGGGAGATCTAGATCGGGTTTTATC (SEQ ID NO: 489) |

TABLE 14-continued

| Name | Sequence 5' to 3' |
|---|---|
| Primers to clone oleA into *B. subtilis* expression vector pHT01 | |
| LB386 | TATATCTAGACCCGGGTTACCACACAACCTCAG (SEQ ID NO: 490) |
| LB388 | TATAGGATCCATGTTGTTCAAAA (SEQ ID NO: 491) |

TABLE 15

| Vectors | | | Source |
|---|---|---|---|
| pET-21b(+) | T7 expression | | Novagen Brand |
| pET-21d(+) | vectors | | EMD Chemicals, Inc. |
| pCOLADuet-1 | | | Gibbstown, NJ 08027 |
| pCDFDuet-1 | | | |
| pETDuet-1 | | | |
| pACYCDuet-1 | | | |
| pJ201 | Vector backbone used by DNA2.0 | | DNA2.0 Menlo Park, CA |
| pEX18-Tc | Suicide vector for *S. maltophilia* | | Hoang et al. 1998 |
| pESC-HIS | Expression vector used in *S. cerevisiae* | | Stratagene, La Jolla, CA |
| pTrcHis2A | Expression vector | | Invitrogen, Carlsbad, CA |
| pCL1920 (NCCB#3176) | Low copy number plasmid | | The Netherlands Culture Collection of Bacteria, Utrecht, The Netherlands |
| pCL1920pTrc | Low copy number plasmid for expression | | Described herein |
| pLoxCat2 | | | Palmeros et al. 2000 |
| pJW168 | | | |
| pKD46 | | | Datsenko and Wanner 2000 |
| pMAL-c2X | | | NEB, Ipswich, MA |
| pWH1520 | Expression vector used in *B. megaterium* | | Mo Bi Tec, Germany |
| pHT01 | Expression vector used in *B. subtilis* | | Mo Bi Tec, Germany |
| Expression Constructs | Vector | Insert | |
| OleA from *S. maltophilia*: pET-21b(+)_OleA pET-21d(+)_OleA pCOLADuet-1_OleA pCDFDuet-1_OleA pETDuet-1_OleA pACYCDuet-1_OleA: ATCC17679 | pET-21b(+), or pCOLADuet-1 cut with NdeI and XhoI | PCR product derived from primers LB118 and LB119 cut with NdeI and XhoI | Described herein |
| OleC from *S. maltophilia*: pET-21b(+)_OleC pET-21d(+)_OleC pCOLADuet-1_OleC pCDFDuet-1_OleC pETDuet-1_OleC pACYCDuet-1_OleC | above vectors cut with NdeI and XhoI | PCR product derived from primers LB155 and LB159 cut with NdeI and XhoI | Described herein |
| OleD from *S. maltophilia*: pET-21b(+)_OleD pET-21d(+)_OleD pCOLADuet-1_OleD pCDFDuet-1_OleD pETDuet-1_OleD pACYCDuet-1_OleD: | above vectors cut with NdeI and XhoI | PCR product derived from primers LB157 and LB158 cut with NdeI and XhoI | Described herein |

TABLE 15-continued

| Vectors | | | Source |
|---|---|---|---|
| OleB from *S. maltophilia*: pET-21b(+)_OleB pET-21d(+)_OleB pCOLADuet-1_OleB pCDFDuet-1_OleB pETDuet-1_OleB pACYCDuet-1_OleB | above vectors cut with NdeI and XhoI | PCR product derived from primers LB151 and LB152 cut with NdeI and XhoI | Described herein |
| OleA and OleB from *S. maltophilia*: pET-21b(+)_OleAB pET-21d(+)_OleAB pCOLADuet-1_OleAB pCDFDuet-1_OleAB pETDuet-1_OleAB pACYCDuet-1_OleAB | above vectors cut with NdeI and XhoI | PCR product derived from primers LB118 and LB152 cut with NdeI and XhoI | Described herein |
| OleC and OleD from *S. maltophilia*: pET-21b(+)_OleCD pET-21d(+)_OleCD pCOLADuet-1_OleCD pCDFDuet-1_OleCD pETDuet-1_OleCD pACYCDuet-1_OleCD | above vectors cut with NdeI and XhoI | PCR product derived from primers LB155 and LB158 cut with NdeI and XhoI | Described herein |
| OleA codon optimized (CO) for expression in *E. coli*, amino acid sequence based on *S. maltophilia*: pET-21d_OleA(CO) pCOLADuet-1_OleA(CO) | pET-21d, or pCOLADuet-1 cut with NcoI and HindIII | PCR product derived from primers LF305 and LF306 cut with PciI and HindIII | Described herein |
| OleA *Xanthomonas axonopodis* pET-21d_OleA(Xan) pCOLADuet-1_OleA(Xan) | above vectors cut with NcoI and HindIII | PCR product derived from primers LF307 and LF308 cut with PciI and HindIII | Described herein |
| OleA *Chloroflexus aggregans* pET-21d_OleA(Chl) pCOLADuet-1_OleA(Chl) | above vectors cut with NcoI and HindIII | PCR product derived from primers LF314 and LF315 cut with PciI and HindIII | Described herein |
| OleC *Chloroflexus aggregans* pET-21d_OleC(Chl) pCOLADuet-1_OleC(Chl) | above vectors cut with NcoI and HindIII | synthetic DNA restriction fragment cut with NcoI and HindIII encoding the *Chloroflexus aggregans* OleC protein | Described herein |
| OleC *Plesiocystis pacifica* pET-21d_OleC(Ple) pCOLADuet-1_OleC(Ple) | above vectors cut with NcoI and HindIII | synthetic DNA restriction fragment cut with NcoI and HindIII encoding the *Plesiocystis pacifica* OleC protein | Described herein |
| OleC *Xanthomonas axonopodis* pET-21d_OleC(Xan) pCOLADuet-1_OleC(Xan) | above vectors cut with NcoI and HindIII | synthetic DNA restriction fragment cut with NcoI and HindIII encoding the *Xanthomonas axonopodis* OleC protein | Described herein |
| OleD *Chloroflexus aggregans* pET-21d_OleD(Chl) pCOLADuet-1_OleD(Chl) | above vectors cut with NcoI and HindIII | synthetic DNA restriction fragment cut with NcoI and HindIII encoding the *Chloroflexus aggregans* OleD protein | Described herein |

TABLE 15-continued

| Vectors | | | Source |
|---|---|---|---|
| OleD *Xanthomonas axonopodis* pET-21d_OleD(Xan) pCOLADuet-1_OleD(Xan) | above vectors cut with NcoI and HindIII | synthetic DNA restriction fragment cut with NcoI and HindIII encoding the *Xanthomonas axonopodis* OleD protein | Described herein |
| pCDFDuet-1_FadD and pETDuet-1_FadD: FadD an acyl-CoA synthase from *E. coli* str. K12 substr. W3110 Genbank Accession # BAA15609 | pCDFDuet-1 or pETDuet-1 cut with NcoI and HindIII | PCR product from *E. coli* derived from primers fadD_F and fadD_R cut with NcoI and HindIII | Described herein |
| pETDuet-1_'TesA: 'TesA gene (thioesterase A gene Genbank accession #AAA24664 without leader sequence (Cho and Cronan, J. Biol. Chem., 270: 4216-9 (1995)) from *E. coli* | pETDuet-1 vector cut with NdeI and AvrII | PCR product from *E. coli* derived from primers TesA_F and TesA_R cut with NdeI and AvrII | Described herein |
| pESC-HIS_OleA: OleA from *S. maltophilia* | pESC-HIS cut with ApaI and XhoI | PCR product derived from primers LB217 and LF304 and cut with ApaI and XhoI | Described herein |
| pCL1920pTrc_OleA: OleA from *S. maltophilia* | pCL1920-pTrc cut with NcoI and XhoI | PCR product derived from primers LB189 and LF304 cut with PciI and XhoI | Described herein |
| pHT01_OleA: OleA from *S. maltophilia* codon optimized for expression in *E. coli* | pHT01 cut with BamHI and XbaI | PCR product derived from primers LB388 and LB386 cut with BamHI and XbaI | Described herein |
| Uc FatB1 | pMAL-c2X vector | PCR product derived from primers UcFatB1_F and UcFatB1_R | Described herein |
| Cc FatB | pETDuet-1 vector cut with NdeI and AvrII | PCR product derived from primers CcFatB_F and CcFatB_R cut with NdeI and AvrII | Described herein |
| Ch FatB2 | pMAL-c2X vector | PCR product derived from primers ChFatB2_F and ChFatB2_R | Described herein |

Cloning Methods:

Standard molecular biology cloning procedures were used to clone DNA into the vectors described in Table 15 (see, e.g., Sambrook et al., supra). Restriction enzymes AatII, AflII, AvrII, BamHI, BglII, HindIII, NcoI, NdeI, NheI, NruI, PciI, ScaI, SfoI, SpeI, XbaI, XhoI, and ZraI were purchased from New England Biolabs (Ipswich, Mass. 01938).

Expression Protocol:

Various scales of fermentations were performed to test for expression or production of product. These protocols are described below and are referred to in each example as either the 5 mL fermentation, the 25 mL fermentation, or an alternative fermentation technique is described.

5 mL Fermentation:

These fermentations were carried out in 15 mL test tubes with 5 mL of Luria Broth Miller (LB) (EMD, Chemicals, Inc., San Diego, Calif.). The cultures were grown to an $OD_{600}$ between 0.1 and 1 and induced with IPTG at a final concentration of 1 mM. The cultures were extracted anywhere from 6 to 48 hours after the induction depending on the experiment. Fermentations were incubated at 25° C., 30° C., or 37° C. with shaking.

25 mL Fermentation:

These fermentations were carried out in 125 mL flasks with a final volume of 25 mL of medium. Seed cultures were prepared by inoculating 5 mL of LB medium in a 15 mL test tube with cells from a scraping of a freezer stock. Freezer stocks were made by adding glycerol to a final concentration of 20% in LB medium and storing the cultures at −80° C. The seed was incubated with shaking at 37° C. until the $OD_{600}$ of the culture reached between 0.15 and 0.6. The cultures were then used to inoculate the fermentation. 22 mL of M9 medium (6 g/L $Na_2HPO_4$, 3 g/L $KH_2PO_4$, 0.5 g/L NaCl, 1 g/L $NH_4Cl$, 1 mg/L thiamine, 1 mM $MgSO_4$, 0.1 mM $CaCl_2$) with 2% glucose was inoculated with 2 mL of LB medium with a cell density of 0.15 $OD_{600}$ units. The cultures were then incubated with shaking until the $OD_{600}$ was between 0.3 and 0.6 units, at which time the cultures were induced with IPTG to a final concentration of 1 mM. In experiments where fatty acids were fed, they were added at the same time point when the cultures were induced. The cultures were extracted anywhere from 2 to 48 hours after the induction, depending on the experiment. Fermentations were incubated at 25° C., 30° C., or 37° C. with shaking.

Cell Lysate Protocol: Standard cell lysis protocols were used. Briefly, cells were disrupted by sonication and/or by the use of the BugBuster® plus Benzonase® nuclease reagent kit (Catalog #70750 Novagen of EMD Chemicals, Inc., San Diego, Calif.). For example, a 10 mL culture was centrifuged at 3500 rpm for 15 minutes (Allegra X-15R Centrifuge with rotor SX-4750A, Beckman Coulter, Fullerton, Calif.), and the resulting pellet was resuspended in 2 mL of BugBuster® and 2 µL of Benzonase® nuclease.

Protein Purification Protocol: His-tagged proteins were purified using standard procedures. Proteins were purified according to the instructions found in User protocol TB054 Rev. F0106 (Novagen of EMD Chemicals, Inc., San Diego, Calif.).

Hydrocarbon Extraction Methods:

Extraction Method 1: 5 mL Pellet Extractions

Organic compounds (olefins, aliphatic ketones, and hydrocarbons) were extracted from bacterial cell pellets using a methanol:hexane extraction protocol. Briefly, 5 mL of culture/fermentation broth was centrifuged in a glass test tube at 3500 rpm for 15 minutes (Allegra X-15R Centrifuge with rotor SX-4750A, Beckman Coulter, Fullerton, Calif.), the supernatant was decanted, the resulting pellet was resuspended in 100 µL of sterile distilled water, and mixed on a vortex mixer until homogeneous. Next, 1 mL of methanol was added and the sample was mixed using a vortex mixer. The sample was then sonicated between 15 minutes to 1.5 hours in a sonicating water bath (Bransonic®, Tabletop Ultrasonic Cleaners, model 5510, Danbury, Conn.). Following the sonication, 4 mL of hexane was added, and the sample was mixed on a vortex mixer. The samples were then centrifuged at 3500 rpm for 15 minutes (Allegra X-15R Centrifuge with rotor SX-4750A, Beckman Coulter, Fullerton, Calif.). The upper layer (hexane layer) was removed and added to a clean glass tube. The sample was then dried under vacuum in a centrifuge (Vacufuge 5301, Eppendorf, Westbury, N.Y.) for approximately 30 minutes until essentially no solvent was present. The sample was then resuspended in 100 µL of ethyl acetate or chloroform. Next, 1 µL of the sample was analyzed on the GC/MS according to the detection methods described below.

Extraction Method 2: Method for In Vitro Assays

For in vitro assays, organic compounds (olefins, aliphatic ketones, and hydrocarbons) were extracted from in vitro samples using an ethyl acetate/1% acetic acid extraction protocol. In vitro assay samples were extracted by the addition of 500 µl of ethyl acetate containing 1% acetic acid. The sample was mixed on a vortex mixer, followed by centrifugation at 3500 rpm for 5 minutes to separate the aqueous and organic layers (Centrifuge 5424 with rotor FA-45-24-11, Eppendorf, Westbury, N.Y.). The top layer (ethyl acetate layer) was transferred to a clean tube. The sample was then dried under vacuum in a centrifuge (Vacufuge 5301, Eppendorf, Westbury, N.Y.) for approximately 30 minutes until essentially no solvent was present. The sample was resuspended in 50 of ethyl acetate and analyzed by GC/MS and/or GC/FID. Between 1 and 10 µL were analyzed on the GC/MS or GC/FID for hydrocarbon content according to the detection methods described below.

Extraction Method 3: Small Scale Whole Cell Culture Extractions

Between 0.5 to 1 mL of the fermentation culture was added to a 1.7 mL Eppendorf tube. This culture was then extracted with between 0.25 to 0.5 mL of ethyl acetate containing the appropriate hydrocarbon spike (e.g., 10 mg/L cis-9-tricosene or 10 mg/L hexacosane for olefins, 10 mg/L 14-heptacosanone for aliphatic ketones, etc.). The culture-ethyl acetate mixture was mixed on a vortex mixer at high speed for 10 minutes. The sample was then centrifuged at 13,000 rpm in an Eppendorf centrifuge for 5 minutes (Centrifuge 5424 with rotor FA-45-24-11, Eppendorf, Westbury, N.Y.). The organic layer (top layer) was removed for analysis using the GC/MS or GC/FID detection methods described below.

Hydrocarbon Detection Methods:

Detection Method 1: 20 Minute GC/MS

For GC/MS detection, hydrocarbons, and aliphatic ketones were observed and verified using the following protocol:
Run Time: 20 minutes
Column: HP-5-MS (5% diphenyl siloxane, 95% dimethyl siloxane) Part No. 19091S-433E,
Length: (meters) 30, Internal diameter: (mm) 0.25 narrowbore, Film: (µM) 0.25
MSD Scan Range: 50-800 M/Z
Inject: 1 µL Agilent 6850 inlet
Inlet: 300° C. splitless
Carrier gas: Helium
Oven Temp: 5 minute hold 100° C.; 25° C./minute to 320° C.; 5 minute hold 320° C.
Det: Agilent 5975B VL MSD
Det. Temp: 300° C.

Detection Method 2: 5 Minute GC/MS

For GC/MS detection, hydrocarbons and aliphatic ketones were detected and verified using the following protocol:
Run Time 4.9 minutes
Column: HP-5-MS (5% diphenyl siloxane, 95% dimethyl siloxane) Part No. 19091S-433E,
Length: (meters) 30, Internal diameter: (mm) 0.25 narrowbore, Film: (µM) 0.25
MSD Scan Range: 50-140 M/Z
Inject: 1 µL Agilent 6850 inlet
Inlet: 300° C. splitless
Carrier gas: Helium
Oven Temp: no hold at 225° C.; 25° C./minute to 320° C.; 1.1 minute hold 320° C.
Det: Agilent 5975B VL MSD
Det. Temp: 300° C.

Detection Method 3: GC/FID

For GC/FID detection, hydrocarbons, and aliphatic ketones were detected and verified using the following protocol:
Run Time: 2.75 to 4 minutes depending on the length of hydrocarbons that you are interested in viewing. Longer times are used for longer hydrocarbons.
Column: Thermo Electron Corporation: (Part No. UFMC 002 000 000 00): Ph5, film thickness 0.4 mm,
Length: (meters) 5,
Internal diameter: 0.1 mm,
Sample volume injected: 1 to 10 µl depending on the experiment
Inlet: splitless
Carrier gas: Helium
Oven Temp: 1 min hold 100° C.; 200° C./min to 350° C.; 0.50 min hold 350° C.
Det: Thermo FID detector Detection Method 4: 5.8 Minute GC/MS For GC/MS detection, hydrocarbons, and aliphatic ketones were observed and verified using the following protocol:
Run Time: 5.83 minutes
Column: DB-1HT (100% Dimethylpolysiloxane) Part No. 122-1111 (Agilent Technologies, Inc), Length: (meters) 15, Internal diameter: (mm) 0.25 narrowbore, Film: (µM) 0.1
MSD Scan Range: 50-550 m/z
Inject: 1 µL Agilent 6890 N inlet
Inlet: 300° C. splitless
Carrier gas: Helium (flow rate: 1.3 mL/min)

Oven Temp: 0.3 minute hold at 160° C.; 30° C./minute to 320° C.; 0.2 minute hold 320° C.
Det: Agilent 5975B XL EI/CI MSD
Det. Temp: 250° C.
Plasmid Construction:

A number of plasmids were constructed for the expression of oleA, oleB, oleC, and oleD in any cell of interest, including *E. coli, B. subtilis, B. megaterium*, and *S. cerevisiae*. These constructs can be divided into plasmids containing individual genes and plasmids containing combinations of genes in operons.

Plasmids Containing Individual Genes oleA, oleB, oleC, and oleD:

The gene sequences for oleA, oleB, oleC, and oleD were derived either by PCR amplification from genomic DNA of a host strain containing these gene sequences or by design and production of synthetic genes on a contract basis (DNA2.0 Inc., Menlo Park, Calif. 94025). Briefly, oleA, oleB, oleC, and oleD were amplified from genomic DNA isolated from *S. maltophilia* ATCC 17679 as follows: oleA (SEQ ID NO: 1) was amplified using primers LB118 (SEQ ID NO: 29) and LB119 (SEQ ID NO: 30); oleB (SEQ ID NO: 9) was amplified using primers LB151 (SEQ ID NO: 35) and LB152 (SEQ ID NO: 36); oleC (SEQ ID NO: 5) was amplified using primers LB155 (SEQ ID NO: 31) and LB159 (SEQ ID NO: 32); oleD (SEQ ID NO: 7) was amplified using primers LB157 (SEQ ID NO: 33) and LB158 (SEQ ID NO: 34). The oleA (SEQ ID NO: 1), oleB (SEQ ID NO: 9), oleC (SEQ ID NO: 5), and oleD (SEQ ID NO: 7) amplification products were inserted into pET-21b(+), pCDFDuet-1, pCOLADuet-1, pETDuet-1, or pACYCDuet-1 using the restriction enzymes NdeI and XhoI. The correct plasmid clones were selected from the resulting transformants and confirmed by DNA digestion and sequencing. Similar cloning methods can be used to insert oleA (SEQ ID NO: 1), oleB (SEQ ID NO: 9), oleC (SEQ ID NO: 5), and oleD (SEQ ID NO: 7) into any vector of interest.

Plasmid pCL1920pTrcOleA was constructed by cloning the oleA nucleotide sequence from the pET21b(+)_OleA plasmid which contains the native oleA DNA sequence from *S. maltophilia* ATCC17679 into the bacterial expression vector pCL1920pTrc using standard cloning techniques as described above. The vector backbone pCL1920pTrc (SEQ ID NO: 24) was constructed at LS9, Inc. Briefly, a PCR product containing the lacIq sequence, the pTrc promoter, and a multiple cloning site was amplified using LF302 (SEQ ID NO: 76) and LF303 (SEQ ID NO: 77) from the plasmid pTrcHis2A (Invitrogen, Carlsbad, Calif.) DNA. The resulting PCR product was digested with AflII and ZraI and cloned by standard DNA ligation into the plasmid pCL1920 (NC-CBNr3176 *Nucl. Acids Res.*, 18: 4631, (1990)) cut with AflII and SfoI. The resulting clones contained the insert in the wrong orientation and the AflII restriction site was not conserved. The resulting plasmid was designated pCL1920pTrc (SEQ ID NO: 24).

To construct plasmid pCL1920pTrcOleA, oleA (SEQ ID NO: 1) was PCR amplified using primers LB189 (SEQ ID NO: 45) and LF304 (SEQ ID NO: 44). The OleA amplification product was cloned into pCL1920pTrc using restriction enzymes PciI and XhoI to create plasmid pCL1920pTrcOleA.

To construct plasmid pHT01_OleA for expression of oleA in *B. subtilis*, oleA (SEQ ID NO:3) was PCR amplified using primers LB388 (SEQ ID NO: 491) and LB386 (SEQ ID NO: 490) from the DNA template pCL1920pTrcOleCDAB, which contains the nucleotide sequence based on the amino acid sequence from *S. maltophilia*, which has been codon optimized for expression in *E. coli*. The OleA amplification product was cloned into pHT01 using restriction enzymes BamHI and XbaI to create plasmid pHT01_OleA.

Plasmids Containing the Olefin Synthase Operon:

Multiple plasmids were constructed that contain the four genes: oleA, oleB, oleC, and oleD in various orders. All fermentations tested with strains expressing the genes from these operons produced olefins. The order of the genes in a synthetic operon does not influence the organism's ability to produce hydrocarbons. Many of these plasmids can be used interchangeably in the examples described below. The actual plasmids used in each example are described in the pertinent example.

In plasmids containing ole genes based on the amino acid sequences from *S. maltophilia*, the plasmids were named depending on the order of the genes in the DNA sequence, for example, with OleA, OleB, OleC, OleD, OleAB, OleBC, OleCD, OleABCD, etc.

When the ole gene is from another organism's genome, the gene name is followed by brackets with the first three letters of the organism from which the gene was derived. For example, OleA(Xan) denotes the gene sequence encoding the amino acid sequence of OleA found in the *Xanthomonas axonopodis* genome sequence.

A synthetic operon containing the oleA, oleB, oleC, and oleD genes encoding the *S. maltophilia* based protein sequences was created. The ole genes were codon optimized for expression in *E. coli* by program modification at DNA2.0, Inc. (Menlo Park, Calif. 94025).

The synthesized gene sequence (SEQ ID NO: 23) was used to construct plasmid pCL1920pTrcOleABpTrcLOleCD. The synthetic olefin operon (SEQ ID NO: 23) provided by DNA 2.0 was subcloned into the plasmid pCL1920pTrc. The operon fragment was isolated by digesting with PciI and HindIII, and ligated into the pCL1920pTrc plasmid cut with NcoI and HindIII. The resulting clone is designated pCL1920pTrcOleABpTrcLOleCD (SEQ ID NO: 78).

Another plasmid, pCL1920pTrcOleCDAB, containing the four olefin synthase genes (oleA, oleB, oleC and oleD) in a different order was constructed and used in some of the following examples. This plasmid was constructed as follows: first, the plasmid pCL1920pTrcOleCD was constructed by cloning a PCR product containing the lacI$^q$ sequence into the NheI and SpeI digested vector backbone of pCL1920pTrcOleABpTrcLOleCD. The resulting plasmid contains the lacI$^q$ sequence upstream of the oleC and oleD genes. The lac repressor containing PCR product was amplified using LB270 (SEQ ID NO: 79) and LB271 (SEQ ID NO: 80) from pCL1920pTrc, the PCR product and vector were prepared for cloning by digestion with NheI and SpeI.

Second, the operon plasmid, pCL1920pTrcOleCDAB, was then constructed by cloning a PCR fragment containing oleA and oleB downstream of oleC and oleD in the pCL1920pTrcOleCD plasmid. The oleAB PCR product was amplified using LB272 (SEQ ID NO: 81) and LB275 (SEQ ID NO: 82) from pCL1920pTrcOleABpTrcLOleCD. The resulting PCR product was digested with BamHI and BglII and cloned by standard DNA ligation into the pCL1920pTrcOleCD digested with BamHI and BglII and treated with Antarctic Phosphatase (New England Biolabs, Ipswich, Mass. 01938). The resulting plasmid was designated pCL1920pTrcOleCDAB. Similar methods can be used to insert a synthetic olefin operon into any vector of interest.

To construct plasmid pWH1520_OleCDAB for expression in *B. megaterium*, oleC, oleD, oleA, and oleB were PCR amplified using primers LB402 (SEQ ID NO: 488) and LB387 (SEQ ID NO: 489) from the DNA template pCL1920pTrcOleCDAB which contains the nucleotide sequence based on the amino acid sequence from *S. maltophilia* which has been codon optimized for expression in *E. coli*. The PCR product containing oleC, oleD, oleA, and oleB was digested with SpeI and BglII and cloned into pWH1520 using restriction enzymes SpeI and BamHI to create plasmid pWH1520_OleCDAB.

Plasmids Containing Thioesterase Genes:

Multiple plasmids were constructed that contain the coding region for different thioesterases, including (Uc FatB1, Cc FatB1, Ch FatB2, and 'tesA. The gene sequence for *E. coli* 'tesA was derived by PCR amplification from genomic DNA from *E. coli* MG1655. The gene sequences for *Umbellularia californica* FatB1 (Uc FatB1), *Cinnamomum camphora* FatB1 (Cc FatB1), and *Cuphea hookeriana* FatB2 (Ch FatB2) were derived by design and production of synthetic genes on a contract basis (Codon Devices, Cambridge, Mass. 02139). Briefly, 'tesA (SEQ ID NO: 25) was amplified using primers TesA_F (SEQ ID NO: 50) and TesA_R (SEQ ID NO: 51). The synthetic genes were recloned into expression plasmids by PCR amplification and standard digestion and ligation protocols. Cc FatB1 (SEQ ID NO: 26) was amplified using primers CcFatB_F (SEQ ID NO: 52) and CcFatB_R (SEQ ID NO: 53). Ch FatB2 (SEQ ID NO: 27) was amplified using primers ChFatB2_F (SEQ ID NO: 54) and ChFatB2_R (SEQ ID NO: 55). Uc FatB1 (SEQ ID NO: 28) was amplified using primers UcFatB1_F (SEQ ID NO: 56) and UcFatB1_R (SEQ ID NO: 57). The 'tesA (SEQ ID NO: 25) and Cc FatB1 (SEQ ID NO: 26) amplification products were cloned into pETDuet-1 using restriction enzymes NdeI and AvrII. The Ch FatB2 (SEQ ID NO: 27) and Uc FatB1 (SEQ ID NO: 28) amplification products were cloned into pMAL-c2X (NEB, Ipswich, Mass.) in frame with the malE gene using restriction enzymes XbaI and HindIII.

Plasmids Containing the Acyl-CoA Synthase:

The fadD gene was expressed from a number of different constructs, including two distinct vectors, pETDuet-1 and pACYCpTrc, as well as from a constitutive promoter integrated directly into the *E. coli* host strain. These constructs are described below.

pETDuet-1_fadD: The fadD gene encoding acyl-CoA synthase from *E. coli* was cloned into a NcoI/HindIII digested pETDuet-1 vector. The fadD nucleic acid sequence (SEQ ID NO: 492) was PCR amplified from genomic DNA of *E. coli* C41(DE3) using primers fadD_F (SEQ ID NO: 46) and fadD_R (SEQ ID NO: 47). The fadD amplification product was cloned into pETDuet-1 using restriction enzymes NcoI and HindIII to create pETDuet-1 fadD.

pACYCpTrcfadD: To construct pACYCpTrcfadD, the vector plasmid pACYCpTrc was first constructed. The lacI$^q$ and pTrc promoter and terminator regions were PCR amplified using primers pTrc_F (SEQ ID NO: 493) and pTrc_R (SEQ ID NO: 494) from pTrcHis2A (Invitrogen, Carlsbad, Calif.). The PCR product was then digested with AatII and NruI. The PCR product was then cloned into pACYC177 digested with AatII and ScaI. The fadD nucleic acid sequence was PCR amplified using primers fadD_F (SEQ ID NO: 46) and fadD_R (SEQ ID NO: 47) from the genomic DNA from *E. coli* C41(DE3) and cloned into pACYCpTrc by digestion with NcoI and EcoRI to create plasmid pACYCpTrcFadD.

Constitutive Expression of acyl-CoA Synthase

FadD was constitutively expressed by substitution of the 5' flanking region upstream of the fadD gene (SEQ ID NO: 495) with a synthetic DNA sequence containing the T5 promoter sequence (SEQ ID NO: 496) using homologous recombination (allelic exchange) followed by Cre lox antimicrobial resistance marker removal (see e.g., Valle, Fernando and Noemí Flores, Overexpression of Chromosomal Genes in *Escherichia coli*. Vol. 267, Recombinant Gene Expression Reviews and Protocols. Totowa: Humana Press, 2004 and Palmeros et al., *Gene*, 247: 255-64 (2000) for detailed protocols). Briefly, primers LB284 (SEQ ID NO: 83) and LB285 (SEQ ID NO: 84) were used to PCR amplify the loxPcat cassette from pLoxCat2 (SEQ ID NO: 89; Genebank accession # AJ401047). The amplification product was then transformed into MG1655 ΔfadE containing plasmid pKD46 (Genebank accession # AY048746). After selection for integration of the loxPcat cassette, the strain was cured of pKD46, followed by removal of the chloramphenicol resistance using plasmid pJW168 (Palmeros et al., *Gene*, 247: 255-64 (2000)). After confirming the replacement of the fadD promoter by the T5 promoter, the strain was cured of pJW168. The resulting strain is *E. coli* MG1655 Δ, fadE, fadD (+).

EXAMPLE 2

This example demonstrates that expression of OleA, OleC, and OleD in bacteria results in the production of olefins.

oleA, oleC, and oleD nucleic acid sequences were amplified from *S. maltophilia* using PCR. These sequences were inserted into bacterial expression vectors using standard cloning techniques, as described in Example 1. The plasmids containing oleA, oleC, and oleD were then used to transform *E. coli* C41(DE3) ΔfadE. The resulting bacterial strain with the genotype *E. coli* C41(DE3) ΔfadE; pET-21b(+)_OleA, pCOLADuet-1_OleC, pCDFDuet-1_OleD was tested using the 5 mL fermentation protocol and extracted using extraction method 1. The extract was then analyzed by GC/MS using detection method 1, as described in Example 1, for the detection of hydrocarbons (e.g., olefins) and aliphatic ketones. The hydrocarbons observed by GC/MS were mono-, di-, and tri-unsaturated olefins that ranged in carbon chain length from $C_{27}$ to $C_{31}$ (see FIGS. 1 and 2A-J). This demonstrated that the expression of oleA, oleC, and oleD in *E. coli* resulted in the production of olefins. Similar methods can be used to express oleA, oleC, and oleD in any cell of interest. In addition, similar methods can be used to analyze the production of aliphatic ketones or hydrocarbons.

To demonstrate that the expression of oleA, oleB, oleC, and oleD leads to the production of hydrocarbons in a wide range of bacteria, a plasmid pWH1520_OleCDAB was made for the expression of oleA, oleB, oleC, and oleD in *Bacillus megaterium* (see Example 1). *B. megaterium* WH320 premade protoplasts (from Mo Bi Tec, Germany) were transformed with pWH1520_OleCDAB to create the strain *B. megaterium* WH320; pWH1520 OleCDAB. *B. megaterium* WH320 premade protoplasts (from Mo Bi Tec, Germany) were transformed with pWH1520 to make *B. megaterium* WH320; pWH1520 to be used as an empty vector control.

The nucleic acid sequences were amplified by PCR using a plasmid containing the *S. maltophilia E. coli*-codon optimized sequences for oleC, oleD, oleA, and oleB. These sequences were inserted into bacterial expression vectors using standard cloning techniques for *E. coli* (see Example 1). The plasmid containing oleA, oleB, oleC, and oleD (pWH1520_OleCDAB) and an empty vector control plasmid (pWH1520) were then used to transform *B. megaterium* WH320.

*B. megaterium* WH320 protoplasts (Mo Bi Tec, Germany) were transformed with the above mentioned plasmids using the protocol provided with the protoplasts (see, e.g., *Bacillus megaterium* protein expression system Handbook 2007), which is a modification of the method from Puyet et al., *FEMS Microbiol. Lett.*, 40:1-5. (1987).

The resulting bacterial strains with the genotype *B. megaterium* WH320; pWH1520_OleCDAB and *B. megaterium* WH320; pWH1520 were tested using the 5 mL Fermentation Protocol (15 mg/L tetracycline was used to select for cells transformed with the plasmid) which was modified to use 0.5% xylose to induce the cultures instead of IPTG. The extraction method used was Extraction Method 1.

Analysis for the presence of hydrocarbons was conducted by GC/MS analysis using Detection Method 4 as described in Example 1. The GC/MS data was ion extracted for distinct parent ions 350, 364, 378, 392, and 406, which show the production of monounsaturated olefins containing 25, 26, 27, 28, and 29 carbons, respectively (see FIGS. 17A-J).

These compounds elute slightly earlier than straight chain olefin of the same carbon number analyzed under the same conditions. This suggests that *B. megaterium* produced branched chain olefins. Because *B. megaterium* naturally produced branched chain fatty acyl substrates, it is likely that the olefins observed are branched chain olefins Hydrocarbons were not detected in the control extracts from the *B. megaterium* WH320; pWH1520.

The results of the experiments reflected in this example demonstrate that a variety of bacteria can be engineered to express oleA, oleB, oleC, and oleD and produce hydrocarbons. Furthermore, this examples demonstrates that Gram-positive bacteria can be engineered to express oleA, oleB, oleC, and oleD and produce hydrocarbons. Moreover, this example demonstrates that bacteria from the genus *Bacillus* can be engineered to express oleA, oleB, oleC, and oleD and produce hydrocarbons. In addition, this example demonstrates that the types of fatty acyl chains naturally produced by the host organism influence the types of hydrocarbons produced.

Figure 3:
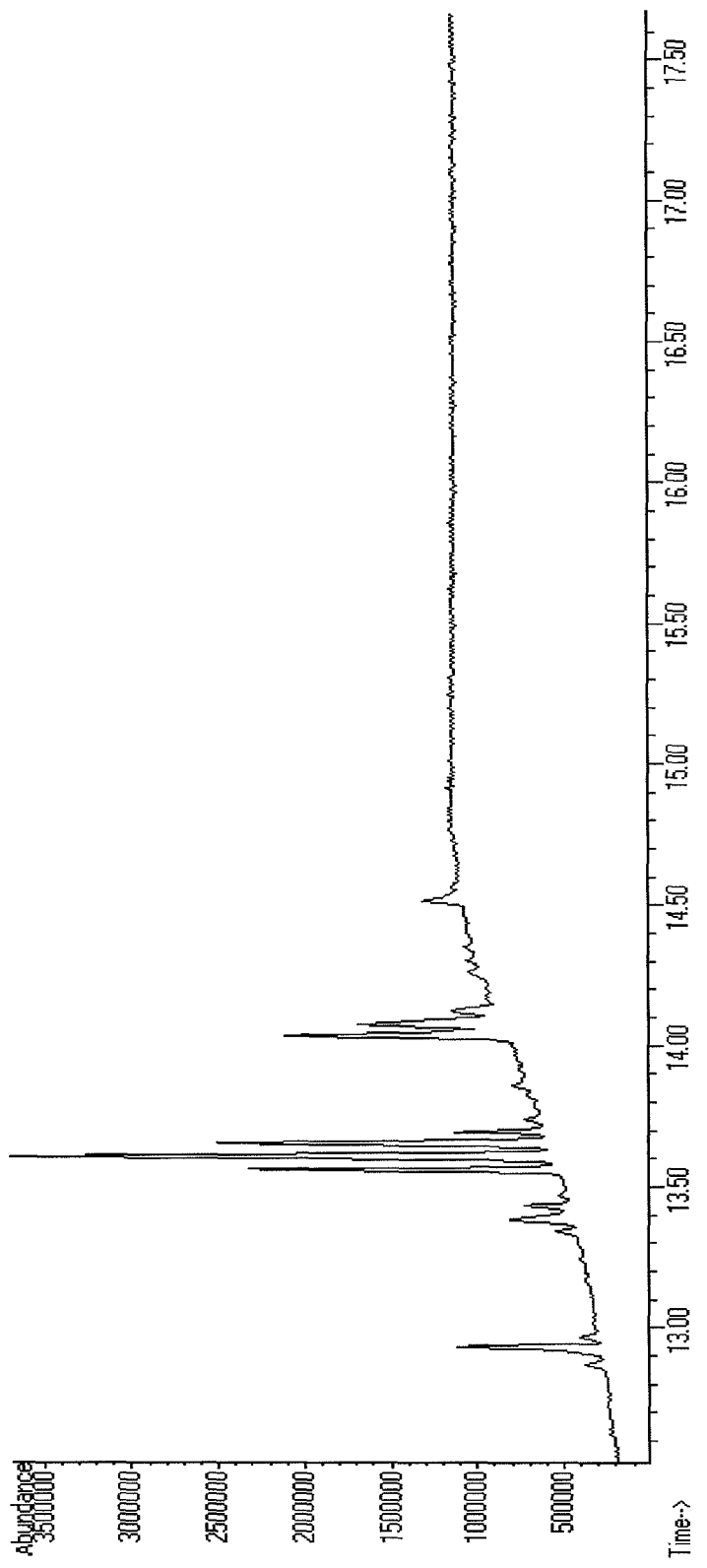
Figure 4A:
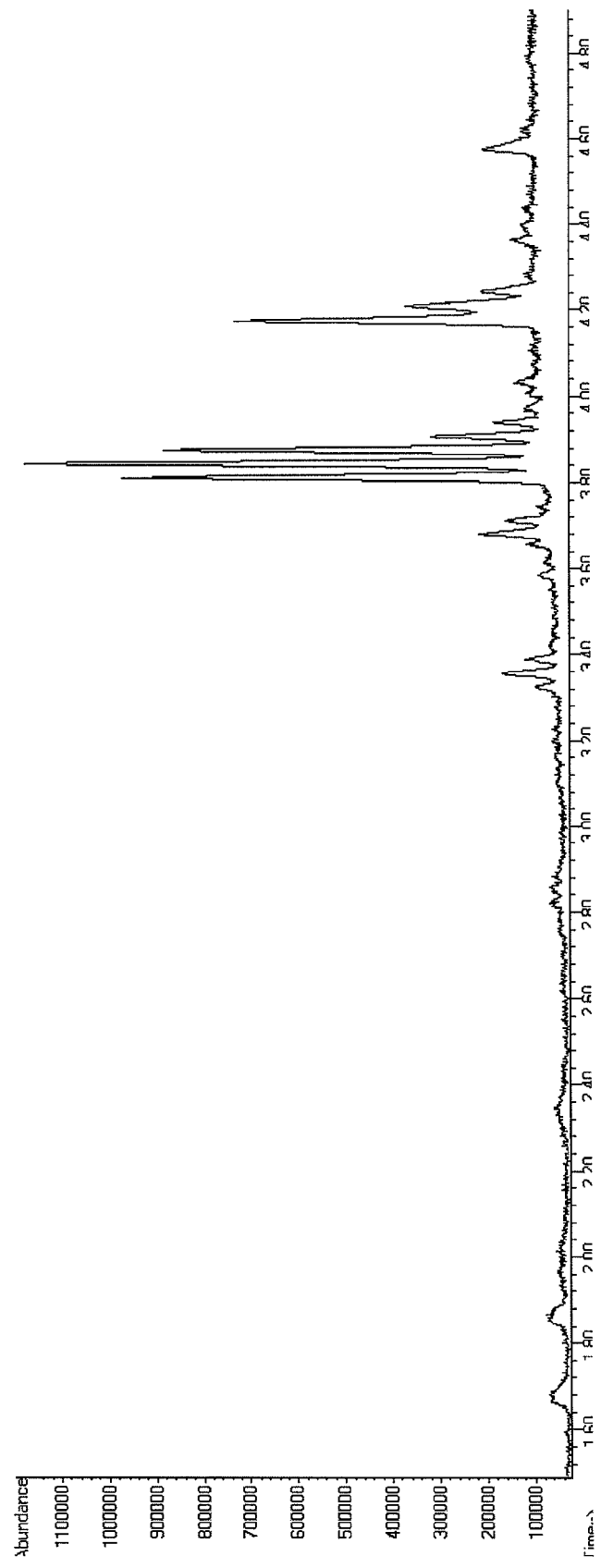
Figure 4B:
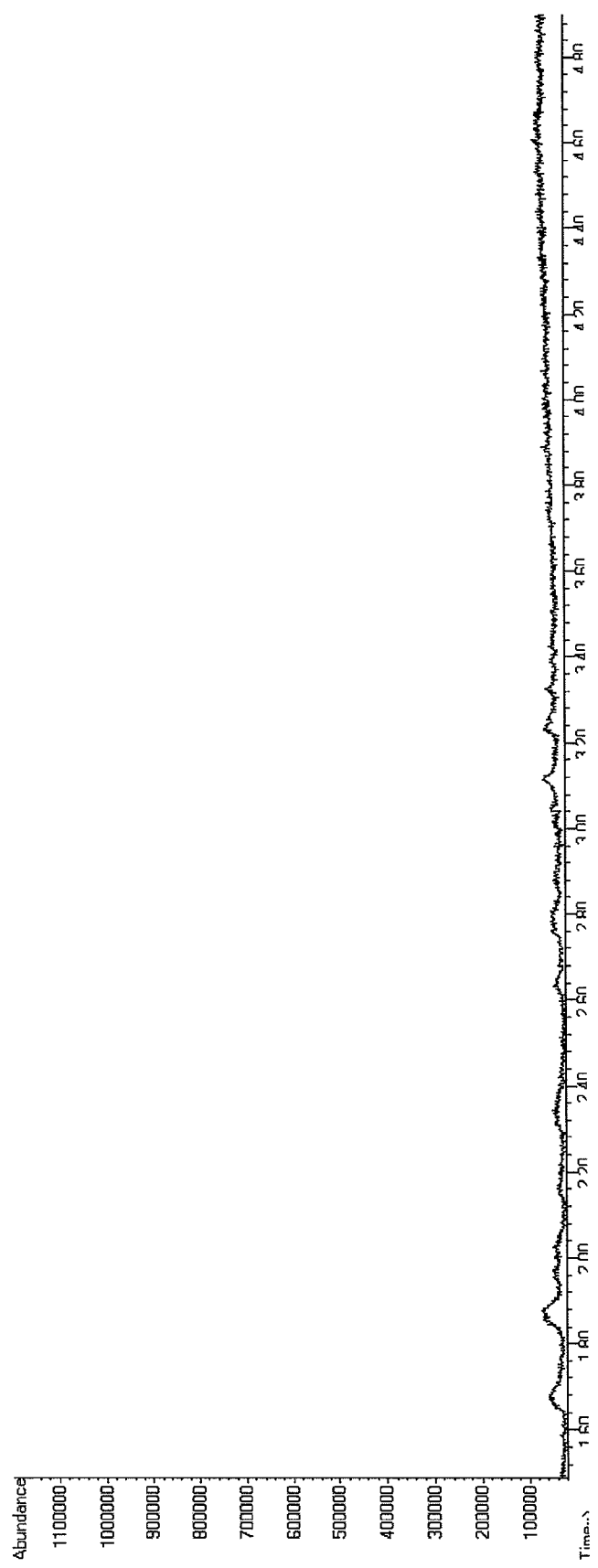
Figure 4C:
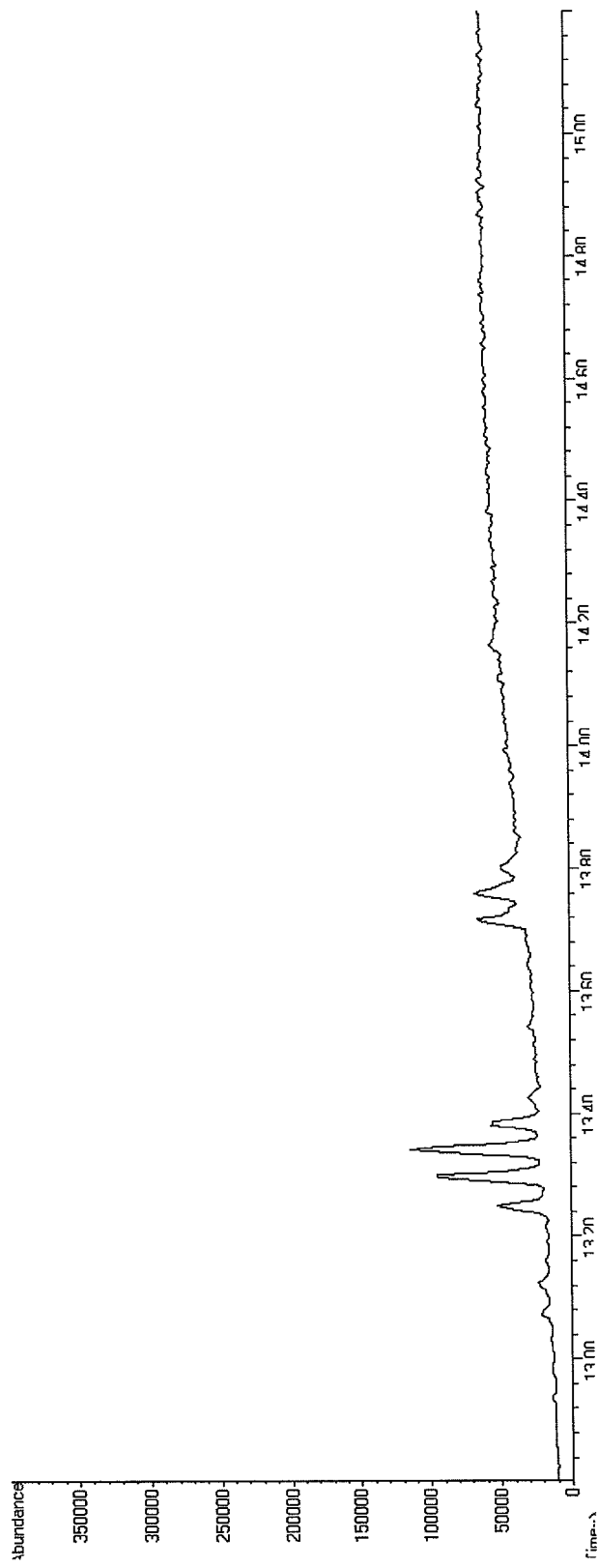

Aliphatic ketones and hydrocarbons (e.g., olefins) were also extracted from bacterial cell pellets of *S. maltophilia* and analyzed using GC/MS using Detection Method 1. The olefins produced by *S. maltophilia* (see FIGS. 3, 4A, and 4C) differ from those produced by *E. coli* oleA, oleC, and oleD (see FIG. 1). Thus, the olefin structures (for instance, the degree of saturation, chain length, and presence of branched or unbranched chains) depend on the host. These differences are a direct reflection of the organism's ability to produce various types of fatty acyl chains. This demonstrates that if the fatty acid biosynthetic pathway is altered, different types of olefins are produced.

To determine if oleA is required for the production of olefins in *S. maltophilia*, an oleA knockout strain of *S. maltophilia* was generated using a suicide vector based method of homologous recombination (allelic exchange) leading to gene deletions. Briefly, the deletion of the oleA gene region was produced using the gene replacement methods described by Hoang et al., *Gene*, 212: 77-86, (1998). More specifically, the upstream and downstream regions of the oleA gene region were amplified and placed together using the SOE PCR technique (see, e.g., Horton et al., *Gene*, 77: 61-8 (1989)). The SOE PCR product was cut with XbaI and HindIII and cloned into a pEX18Tc suicide vector (see Hoang et al., supra) digested with XbaI and HindIII. The 5' flanking region used PCR primers LB200 (SEQ ID NO: 58) and LB203 (SEQ ID NO: 61). The 3' flanking region used PCR primers LB201 (SEQ ID NO: 59) and LB205 (SEQ ID NO:63). The combined PCR deletion product (SEQ ID NO: 75), which was cloned into pEX18Tc, was produced by PCR amplification off of the combination of the 5' and 3' PCR products using PCR primers LB202 (SEQ ID NO: 60) and LB204 (SEQ ID NO: 62).

Extractions from wild type *S. maltophilia* and mutant *S. maltophilia* ΔoleA (*S. maltophilia* lacking oleA) were analyzed by GC/MS, using Detection Method 2. Olefins were observed in the wild type *S. maltophilia* (see FIG. 4A). Olefins were not observed in *S. maltophilia* ΔoleA (see FIG. 4B). These results demonstrate that deletion of the oleA gene resulted in the loss of olefin production in *S. maltophilia*.

To determine if oleC is required for the production of olefins in *S. maltophilia*, an oleC knockout strain of *S. maltophilia* was generated using a suicide vector based method of homologous recombination (allelic exchange) leading to gene deletions. Briefly, the deletion of the oleC gene region was produced using the gene replacement methods described by Hoang et al., *Gene*, 212: 77-86, (1998). More specifically, the upstream and downstream regions of the oleC gene region were amplified and placed together using the SOE PCR technique (see, e.g., Horton et al., *Gene*, 77: 61-8 (1989)). The SOE PCR product was cut with XbaI and HindIII and cloned into a pEX18Tc suicide vector (see Hoang et al., supra) digested with XbaI and HindIII.

The 5' flanking region used PCR primers LB110 (SEQ ID NO: 465) and LB112 (SEQ ID NO: 467). The 3' flanking region used PCR primers LB111 (SEQ ID NO: 466) and LB114 (SEQ ID NO: 469). The combined PCR deletion product (SEQ ID NO: 471), which was cloned into pEX18Tc, was produced by PCR amplification off of the combination of the 5' and 3' PCR products using PCR primers LB113 (SEQ ID NO: 468) and LB115 (SEQ ID NO: 470).

Figure 4D:
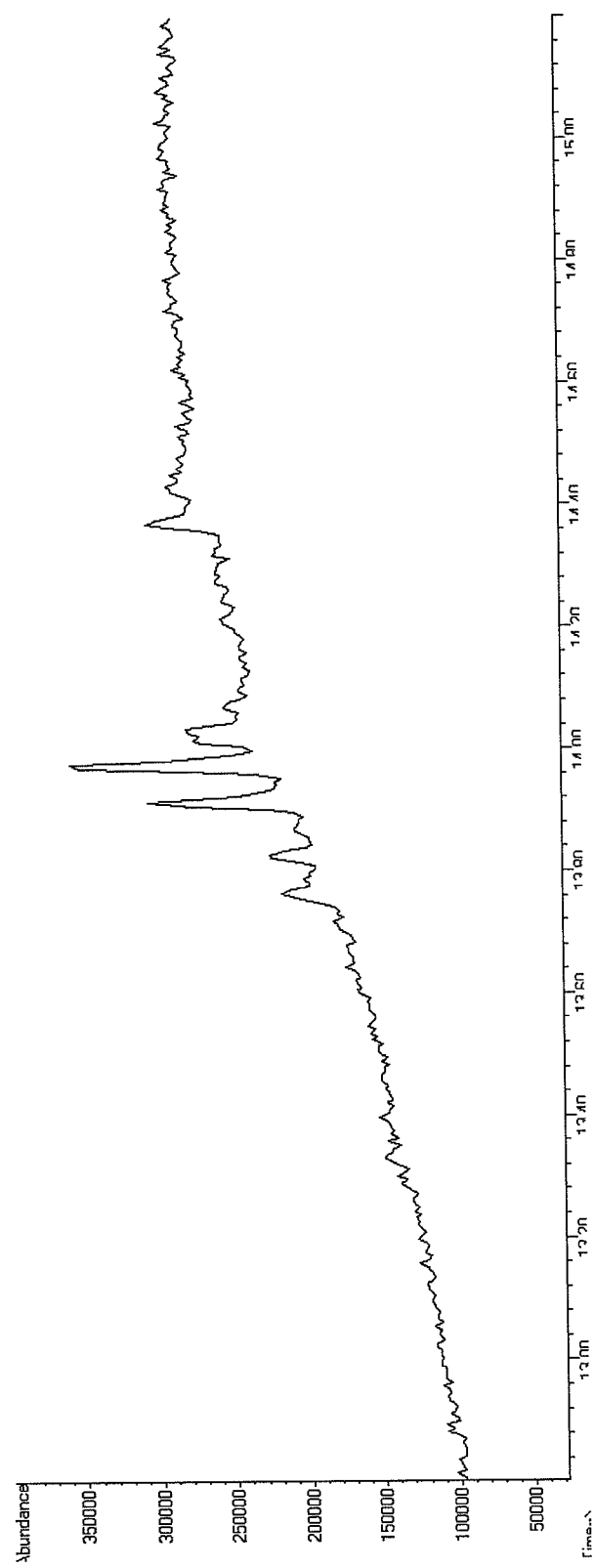

Extractions from wild type *S. maltophilia* and mutant *S. maltophilia* ΔoleC (*S. maltophilia* lacking oleC) were analyzed by GC/MS, using Detection Method 2. Olefins were observed in the wild type *S. maltophilia* (see FIG. 4A). Olefins were not observed in *S. maltophilia* ΔoleC (see FIG. 4D). Aliphatic ketones were observed in the *S. maltophilia* ΔoleC (see FIG. 4D). These results demonstrate that deletion of the oleC gene resulted in the loss of olefin production in *S. maltophilia*.

To determine if oleD is required for the production of olefins in *S. maltophilia*, an oleD knockout strain of *S. maltophilia* was generated using a suicide vector based method of homologous recombination (allelic exchange) leading to gene deletions. Briefly, the deletion of the oleD gene region was produced using the gene replacement methods described by Hoang et al., *Gene*, 212: 77-86, (1998). More specifically, the upstream and downstream regions of the oleD gene region were amplified and placed together using the SOE PCR technique (see, e.g., Horton et al., *Gene*, 77: 61-8 (1989)). The SOE PCR product was cut with XbaI and HindIII and cloned into a pEX18Tc suicide vector (see Hoang et al., supra) digested with XbaI and HindIII.

The 5' flanking region used PCR primers LB122 (SEQ ID NO: 472) and LB124 (SEQ ID NO: 474). The 3' flanking region used PCR primers LB123 (SEQ ID NO: 473) and LB127 (SEQ ID NO:476). The combined PCR deletion product (SEQ ID NO: 477), which was cloned into pEX18Tc, was produced by PCR amplification off of the combination of the 5' and 3' PCR products using PCR primers LB125 (SEQ ID NO: 475) and LB127 (SEQ ID NO: 476).

Figure 4E:
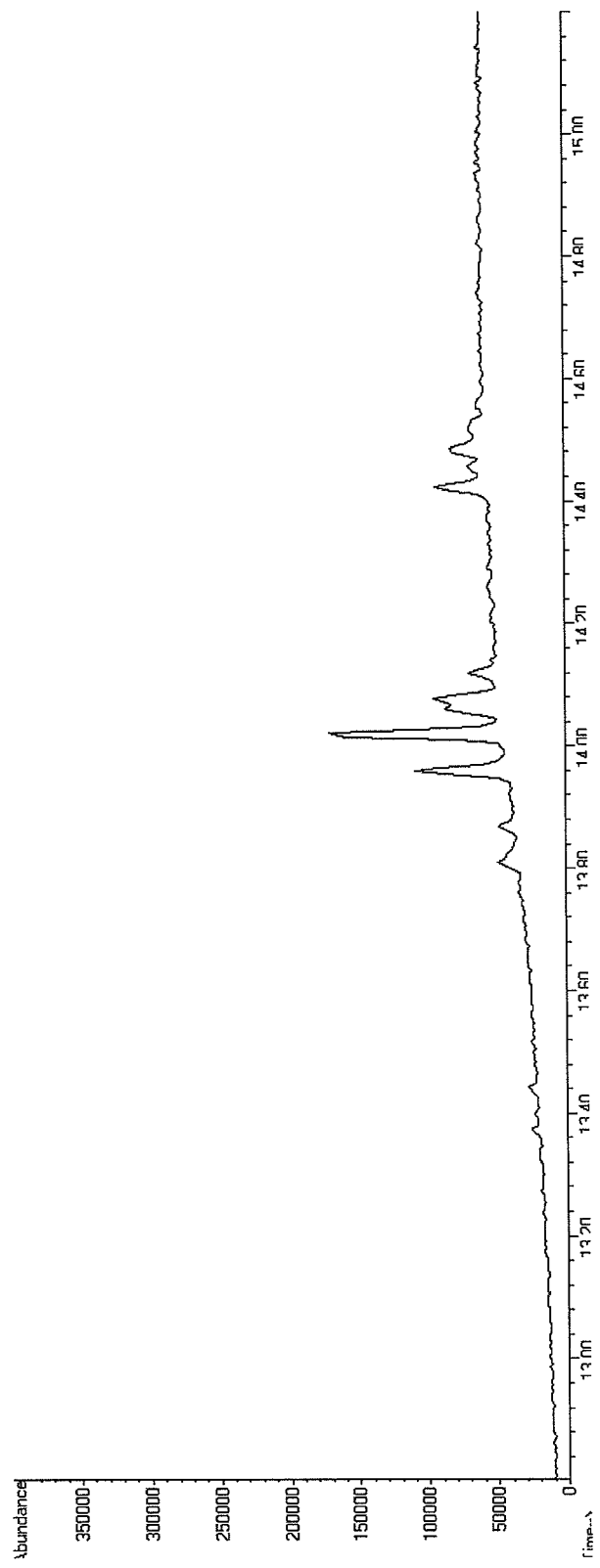
Figure 5A:
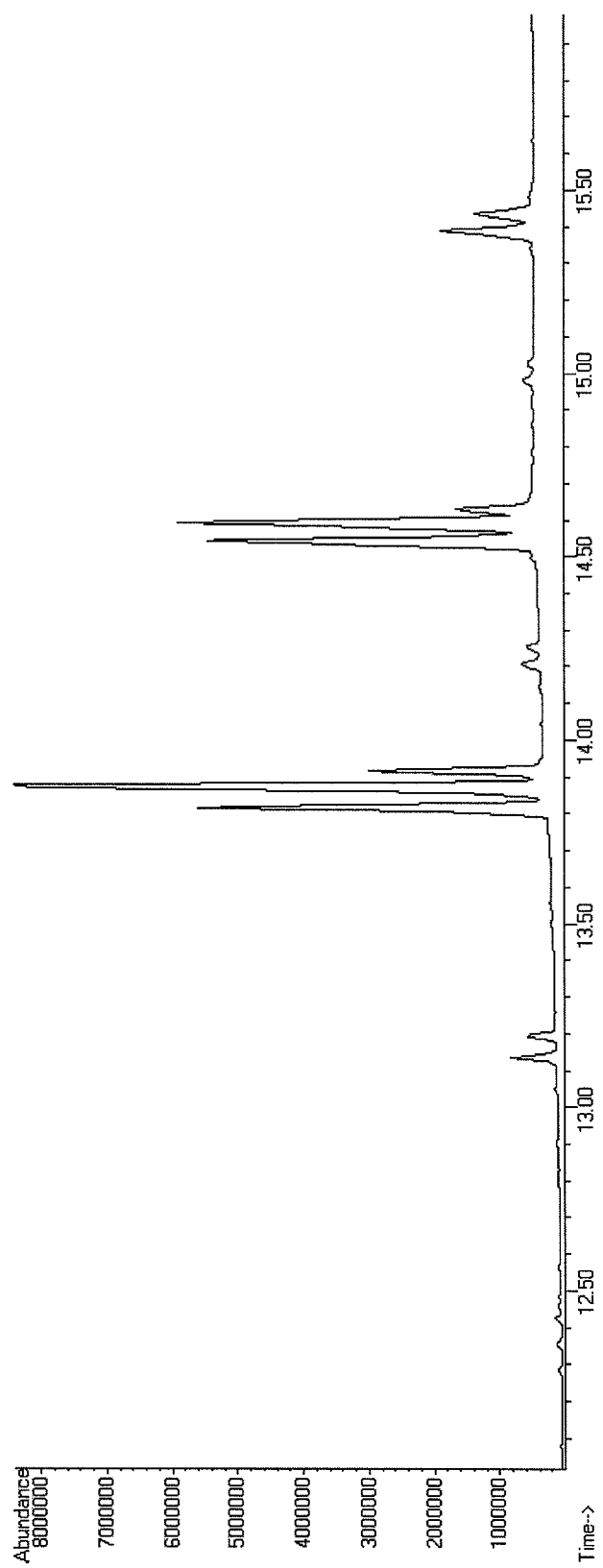
Figure 5B:
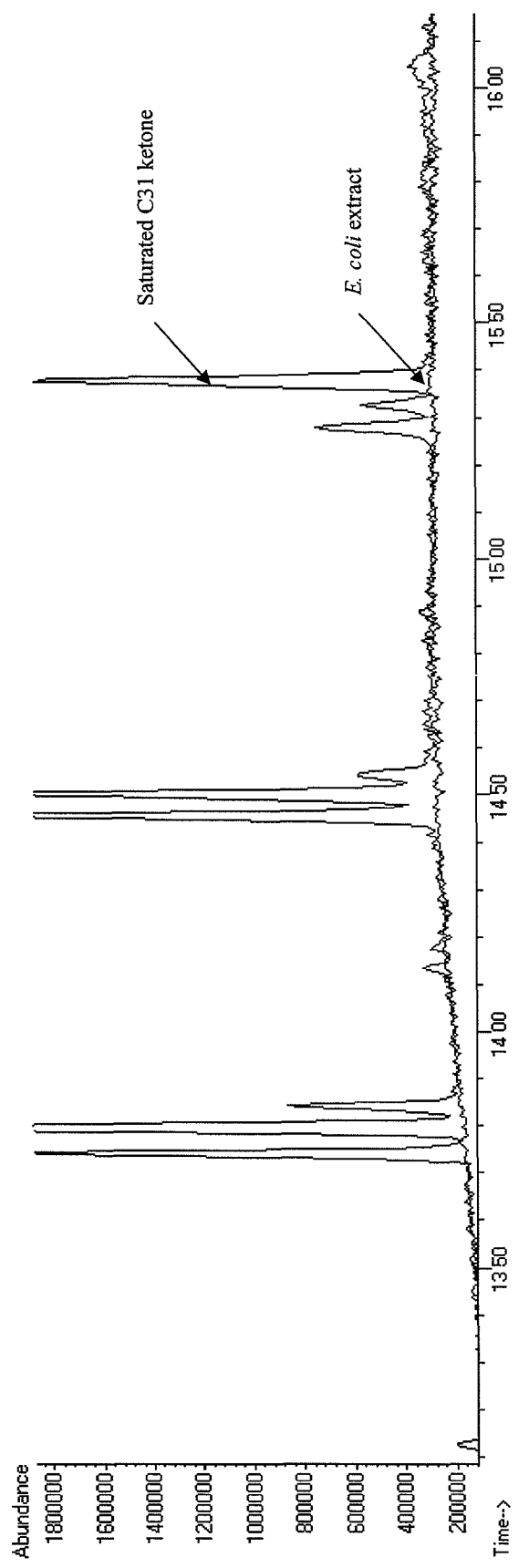
Figure 5C:
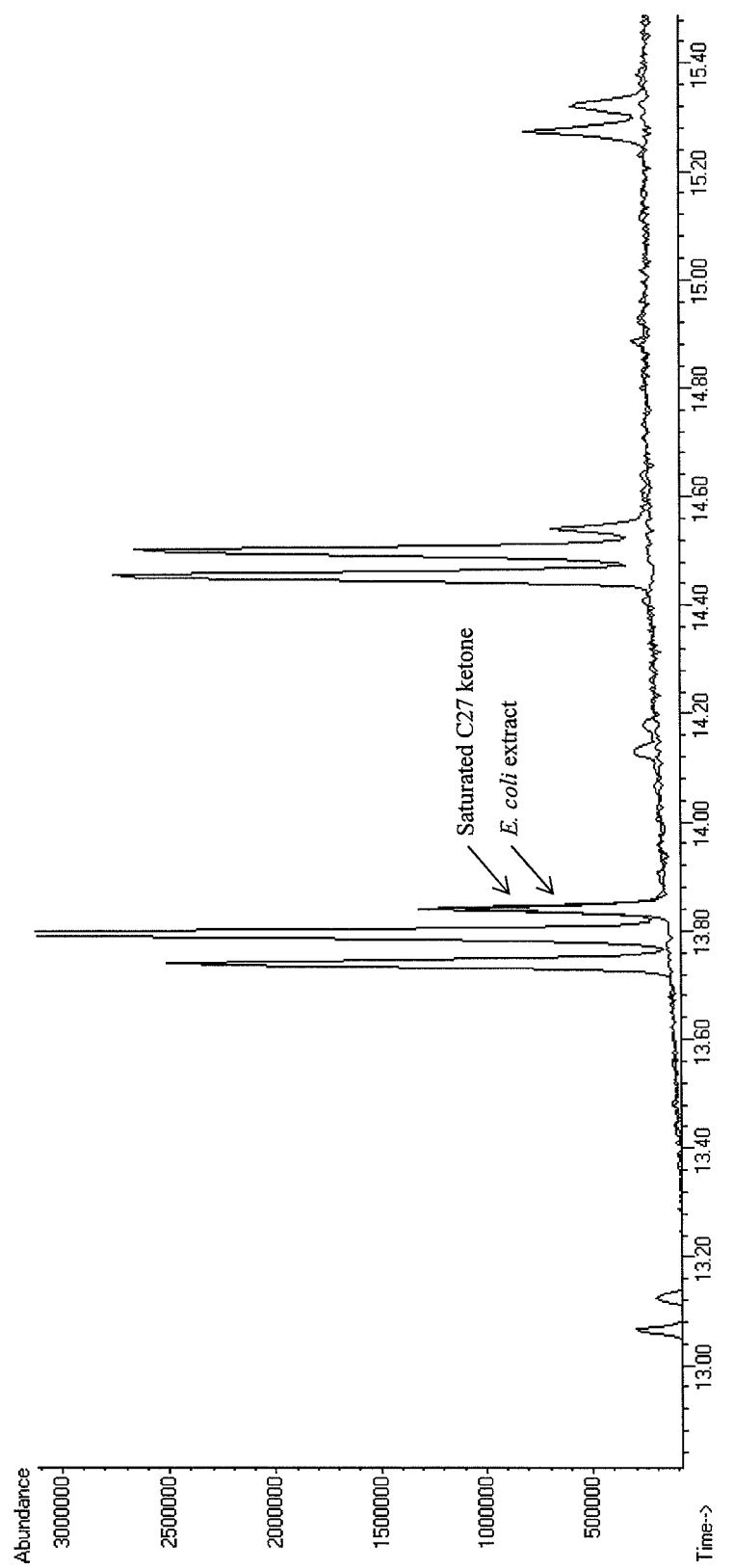
Figure 6A:
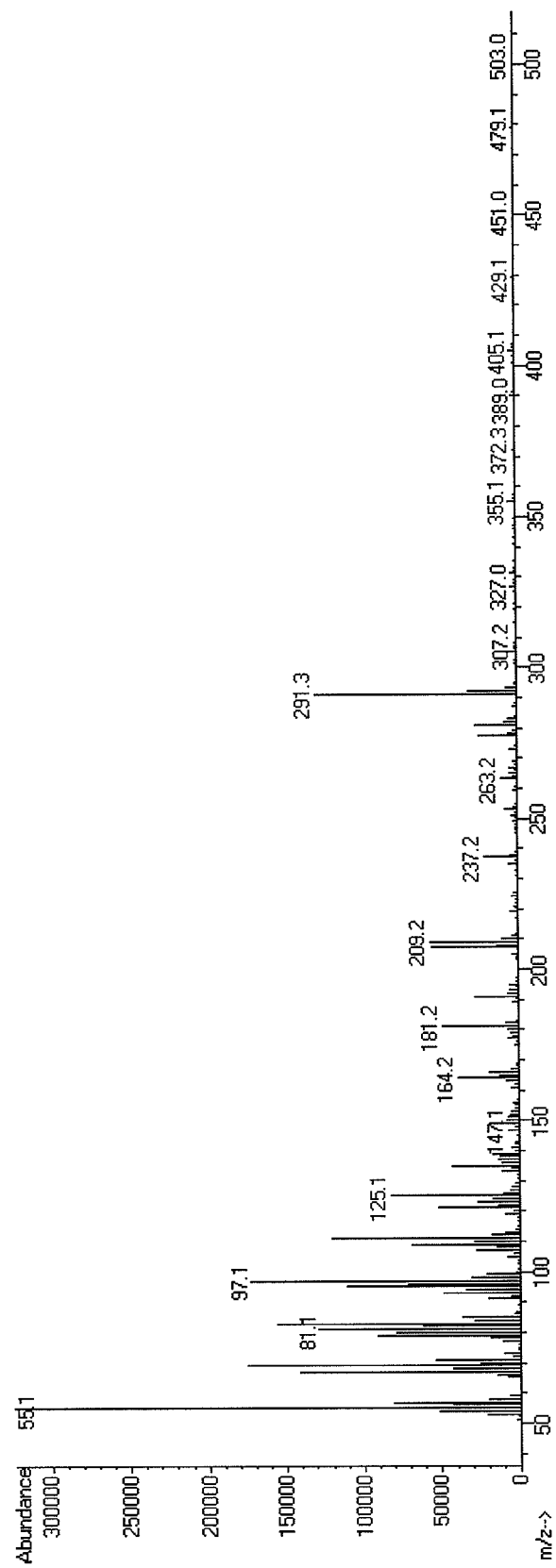
Figure 6B:
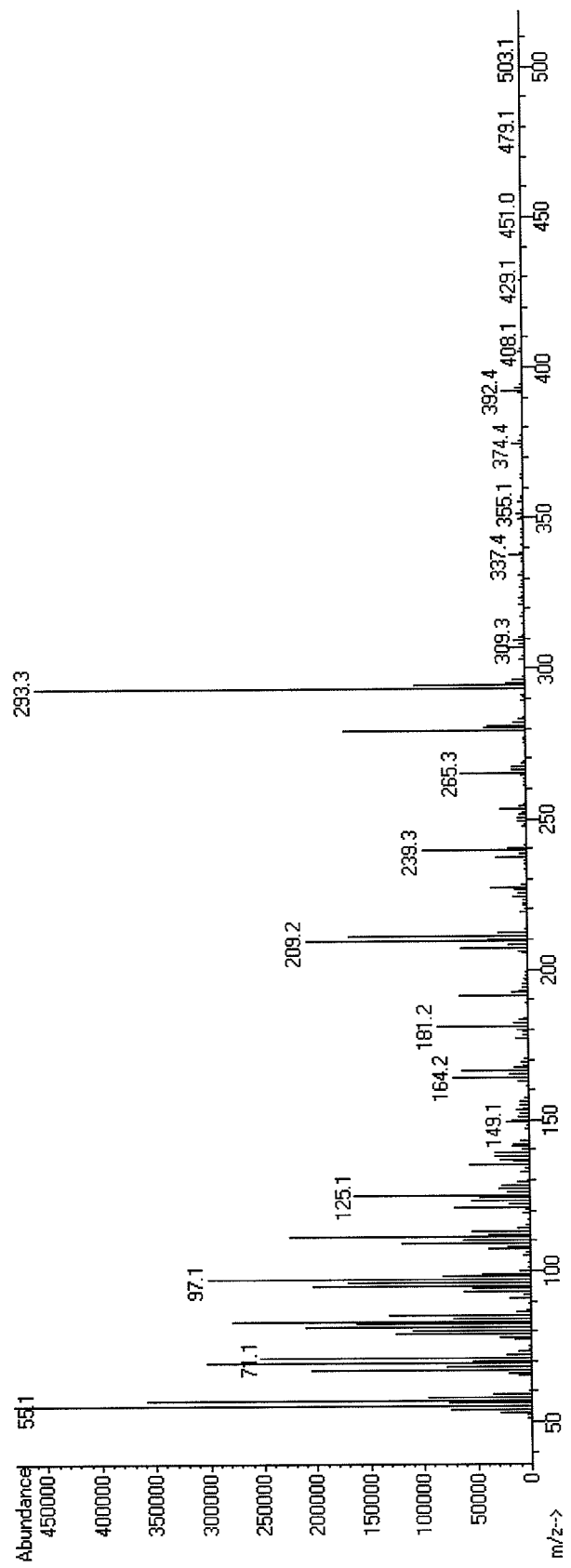
Figure 6C:
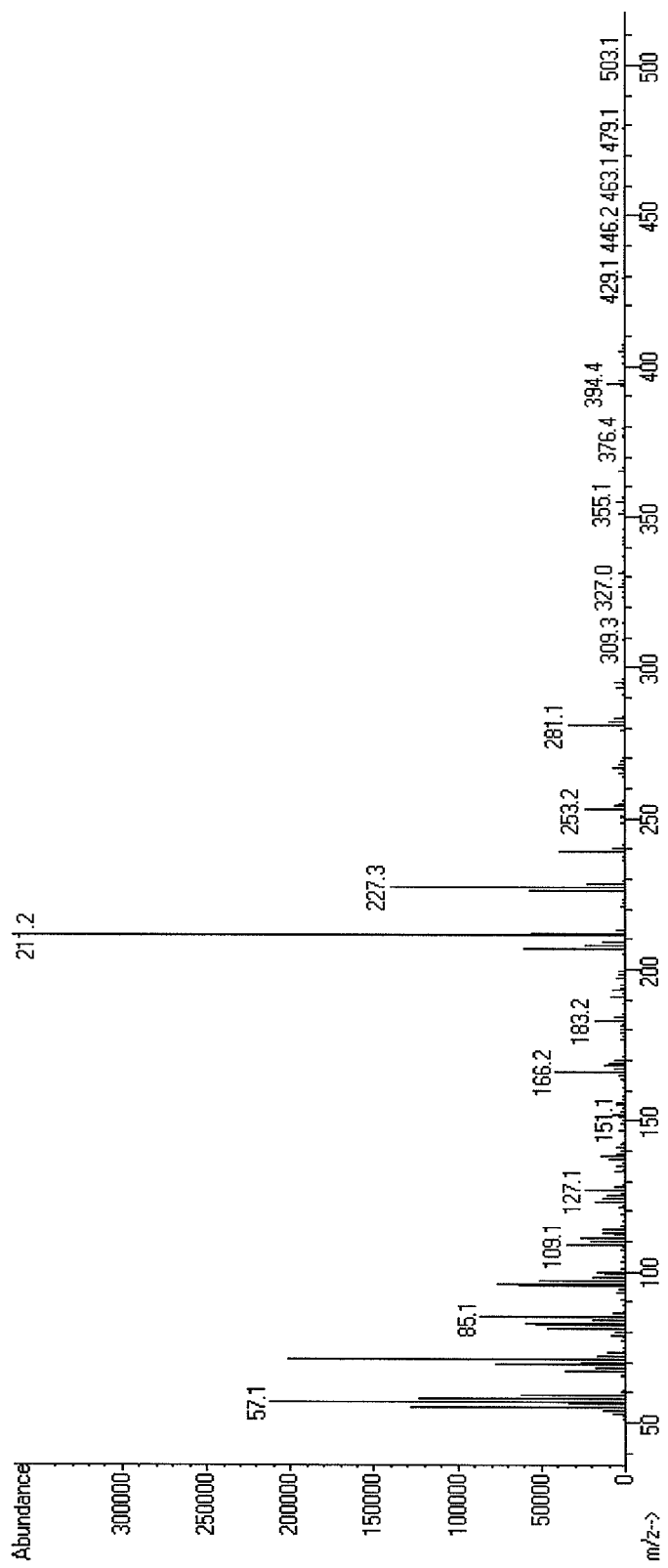
Figure 6D:
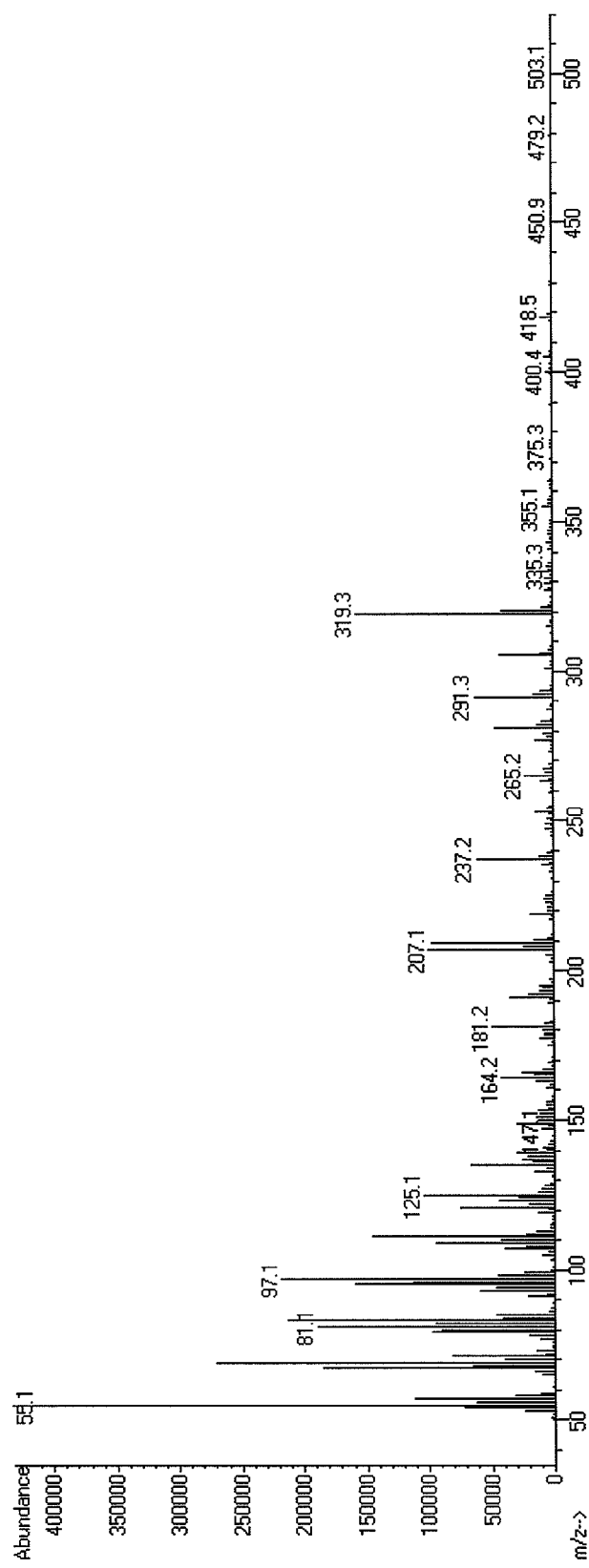
Figure 6E:
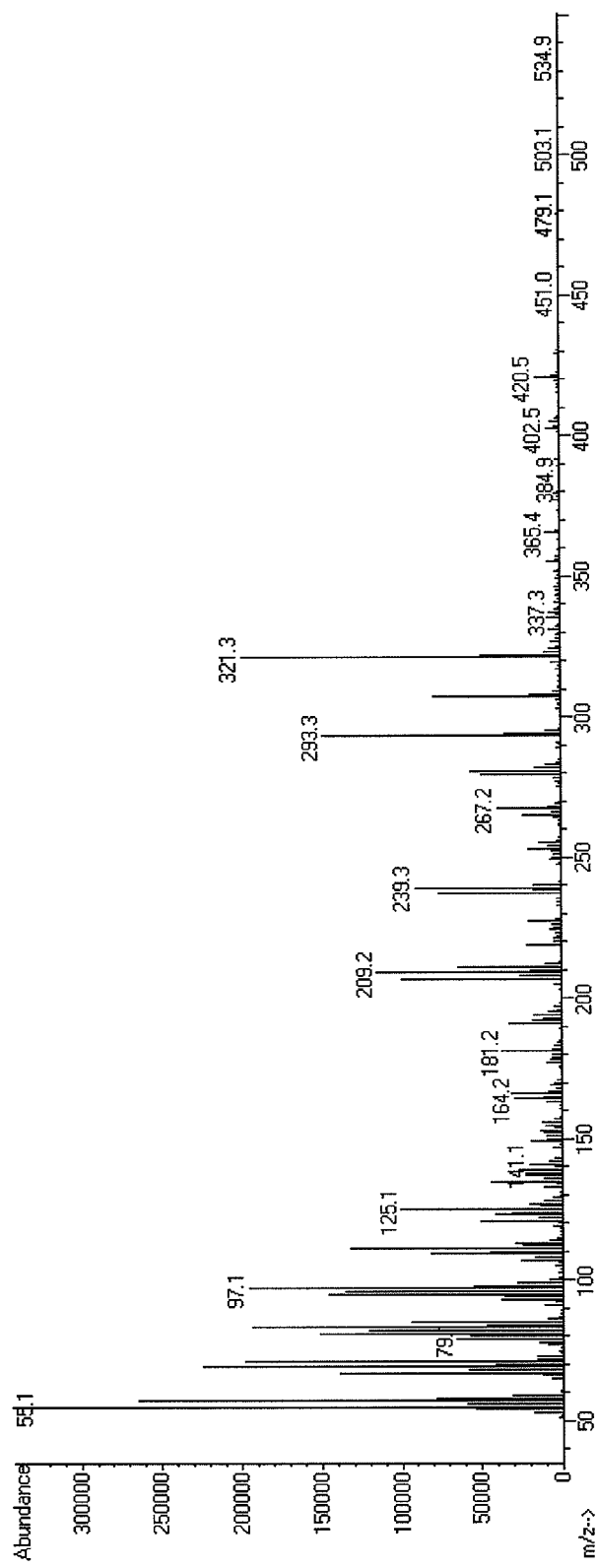
Figure 6F:
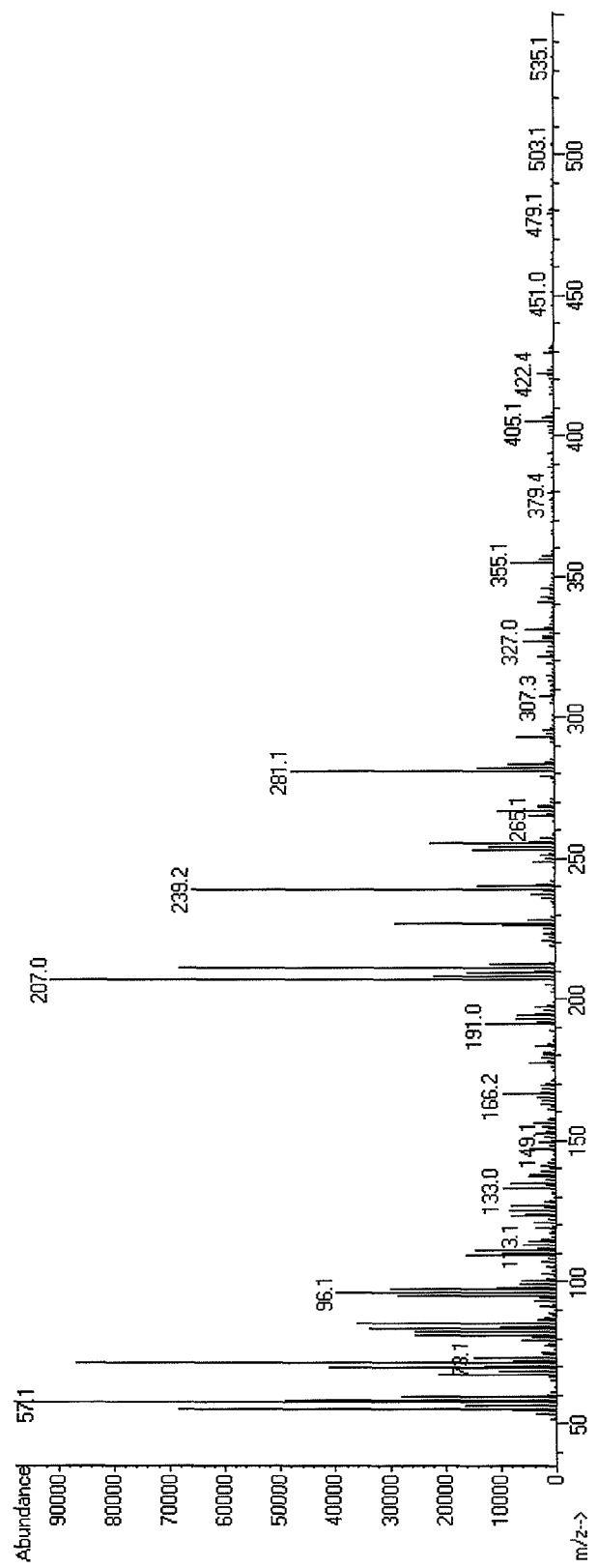
Figure 6G:
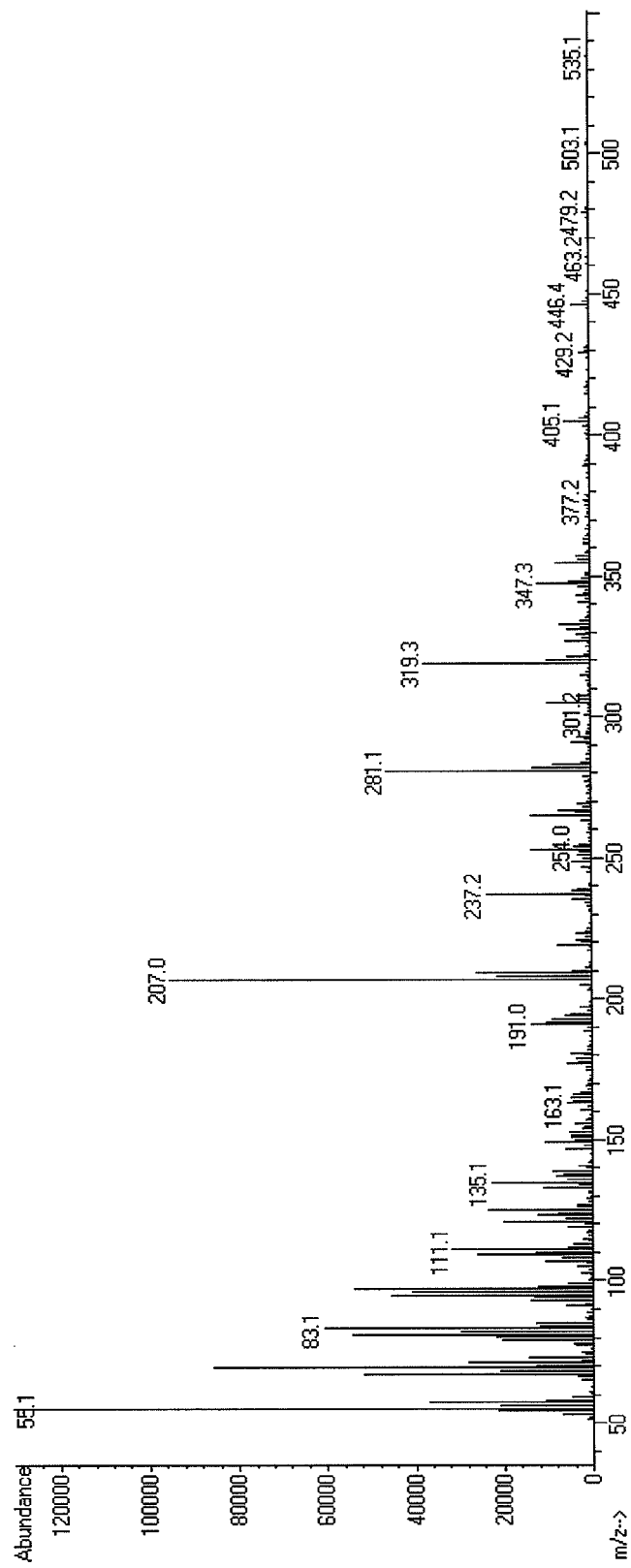
Figure 6H:
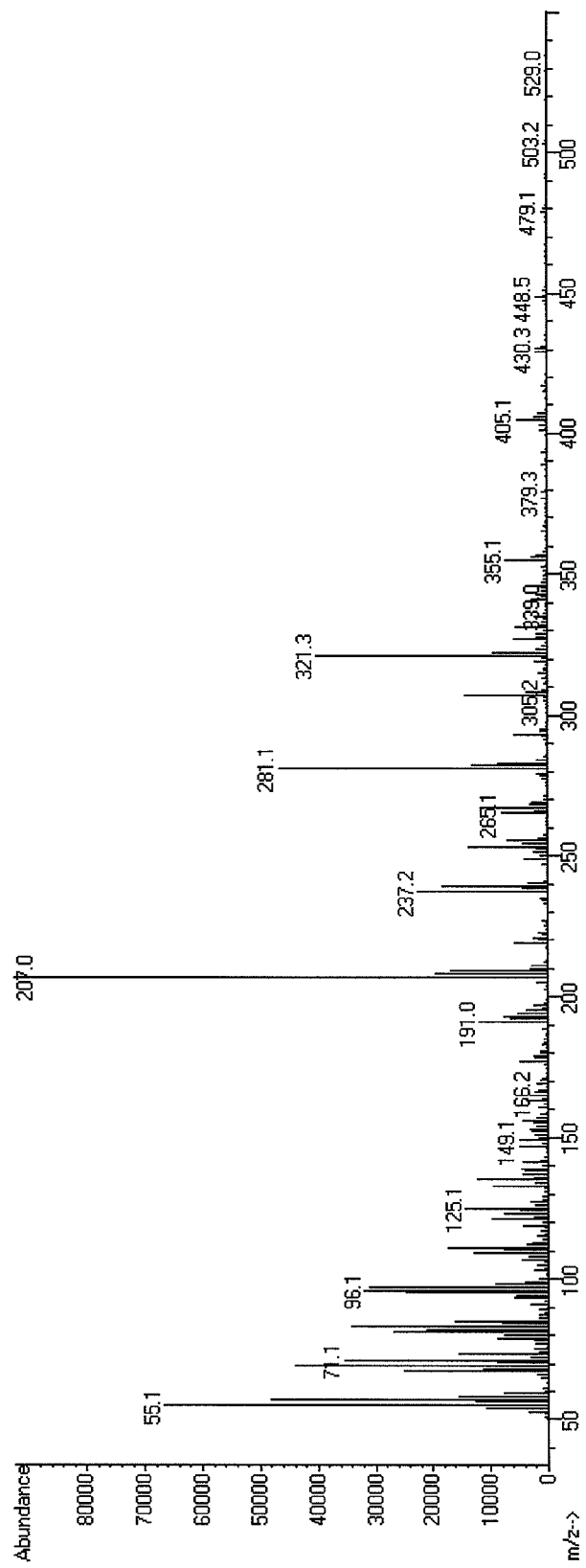

Extractions from wild type *S. maltophilia* and mutant *S. maltophilia* ΔoleD (*S. maltophilia* lacking oleD) were analyzed by GC/MS, using Detection Method 2. Olefins were observed in the wild type *S. maltophilia* (see FIG. 4C). Olefins were not observed in *S. maltophilia* ΔoleD. Aliphatic ketones were observed in the *S. maltophilia* ΔoleD (see FIG. 4E). These results demonstrate that deletion of the oleD gene resulted in the loss of olefin production in *S. maltophilia*.

The results of the experiments reflected in this example demonstrate that the expression of oleA, oleC, and oleD in bacteria results in the production of olefins. The olefins produced may differ in structure depending on the host. Additionally, the results of the experiments reflected in this example demonstrate that OleA, OleC and OleD are required for the production of olefins in *S. maltophilia*.

EXAMPLE 3

This example demonstrates that the expression of oleA in bacteria resulted in the production of aliphatic ketones.

oleA was expressed in *E. coli* as described in Examples 1 and 2. The plasmid containing oleA was used to transform *E. coli* C41(DE3). The resulting bacterial strain with the genotype *E. coli* C41(DE3); pET-21b(+)_OleA was tested using the 5 mL fermentation protocol. Analysis for the production of aliphatic ketones and hydrocarbons (e.g., olefins) was conducted by using Extraction Method 1 followed by the GC/MS analysis, using Detection Method 1 as described in Example 1. The aliphatic ketones observed by GC/MS were saturated, mono-unsaturated, and di-unsaturated aliphatic ketones. The aliphatic ketones ranged in carbon chain length from $C_{27}$ to $C_{31}$ (see FIGS. 5A-C and 6A-H).

To demonstrate that the expression of oleA leads to the production of aliphatic ketones in a wide range of bacteria, plasmid pHT01_OleA was made for expression of oleA in *Bacillus subtilis* (see Example 1). *B. subtilis* IHA01 was transformed with pHT01_OleA to create the strain *B. subtilis* IHA01; pHT01_OleA. *B. subtilis* IHA01 was transformed with pHT01 to make *B. subtilis* IHA01; pHT01 which acted as a control.

The nucleic acid sequences were amplified by PCR using a plasmid containing the *S. maltophilia E. coli*-codon optimized sequence for oleA. These sequences were inserted into bacterial expression vectors using standard cloning techniques for *E. coli* (see, e.g., Example 1).

The plasmid containing oleA (pHT01_OleA) and an empty vector control plasmid (pHT01) were then used to transform *B. subtilis* IHA01. *B. subtilis* was transformed by natural transformation according to the protocols of Spizizen, *Proc. Natl. Acad. Sci. USA*, 44: 1072-1078 (1958).

The resulting bacterial strains with the genotype *B. subtilis* IHA01; pHT01_OleA and *B. subtilis* IHA01; pHT01 were tested using the 5 mL Fermentation Protocol. The extraction method used was Extraction Method 1. Analysis for the presence of aliphatic ketones and hydrocarbons (e.g., olefins) was conducted by GC/MS using Detection Method 4 as described in Example 1. Saturated aliphatic ketones containing 25, 27, and 29 carbons were observed. Multiple peaks for each respective C25, C27, and C29 aliphatic ketone reflects that a number of different branched isomers of the aliphatic ketones was present (see FIGS. 18A-E).

The results of the experiments reflected in this example demonstrate that a variety of bacteria can be engineered to express oleA and produce aliphatic ketones. Furthermore, this example demonstrates that Gram-positive bacteria can be engineered to express oleA and produce aliphatic ketones. Moreover, this example demonstrates that bacteria from the genus *Bacillus* can be engineered to express oleA and produce aliphatic ketones. In addition, this example demonstrates that the types of fatty acyl chains naturally produced by the host organism influence the types of hydrocarbons produced.

EXAMPLE 4

This example demonstrates the ability to observe aliphatic ketone production using an in vitro assay combining lysate from *E. coli* cells expressing oleA (SEQ ID NO: 2) with acyl-CoA substrates.

oleA was expressed in *E. coli* as described in Examples 1 and 3. The resulting recombinant bacteria were cultured, induced, pelleted, and used to make a cell lysate containing OleA (OleA-cell lysate) as described in Example 1. The in vitro assay mixture consisted of 10 µL of a 10 mM stock solution of myristoyl-CoA lithium salt (the substrate) (M4414 from Sigma-Aldrich St. Louis, Mo.) suspended in 0.1 M phosphate buffer pH 7.0, 1 µL of 500 mM tris(hydroxypropyl)phosphine (THP) reducing agent, 50 µL of OleA-cell lysate, and 39 µL of 0.1 M phosphate buffer pH 7.0. Control samples containing combinations with and without substrate or OleA-cell extract were also prepared. Samples were incubated at 37° C. for 1 hour. After the incubation period, 10 µL of 0.1 mg/mL solution of hexacosane was added as a control spike into each reaction before extraction. The samples were extracted using 500 µl of ethyl acetate containing 1% acetic acid. The mixture was mixed on a vortex mixer followed by centrifugation. The top layer (ethyl acetate layer) was transferred to a clean glass tube and dried under vacuum in a centrifuge (Vacufuge 5301, Eppendorf, Westbury, N.Y.). The sample was resuspended in 50 µL of ethyl acetate. Between 1 and 10 µl were analyzed by either GC/MS or GC/FID according to the methods described in Example 1. Similar methods can be used to incubate any OleA-cell lysate with a substrate under conditions sufficient to produce aliphatic ketones and subsequently analyze the production of aliphatic ketones.

Figure 7A:
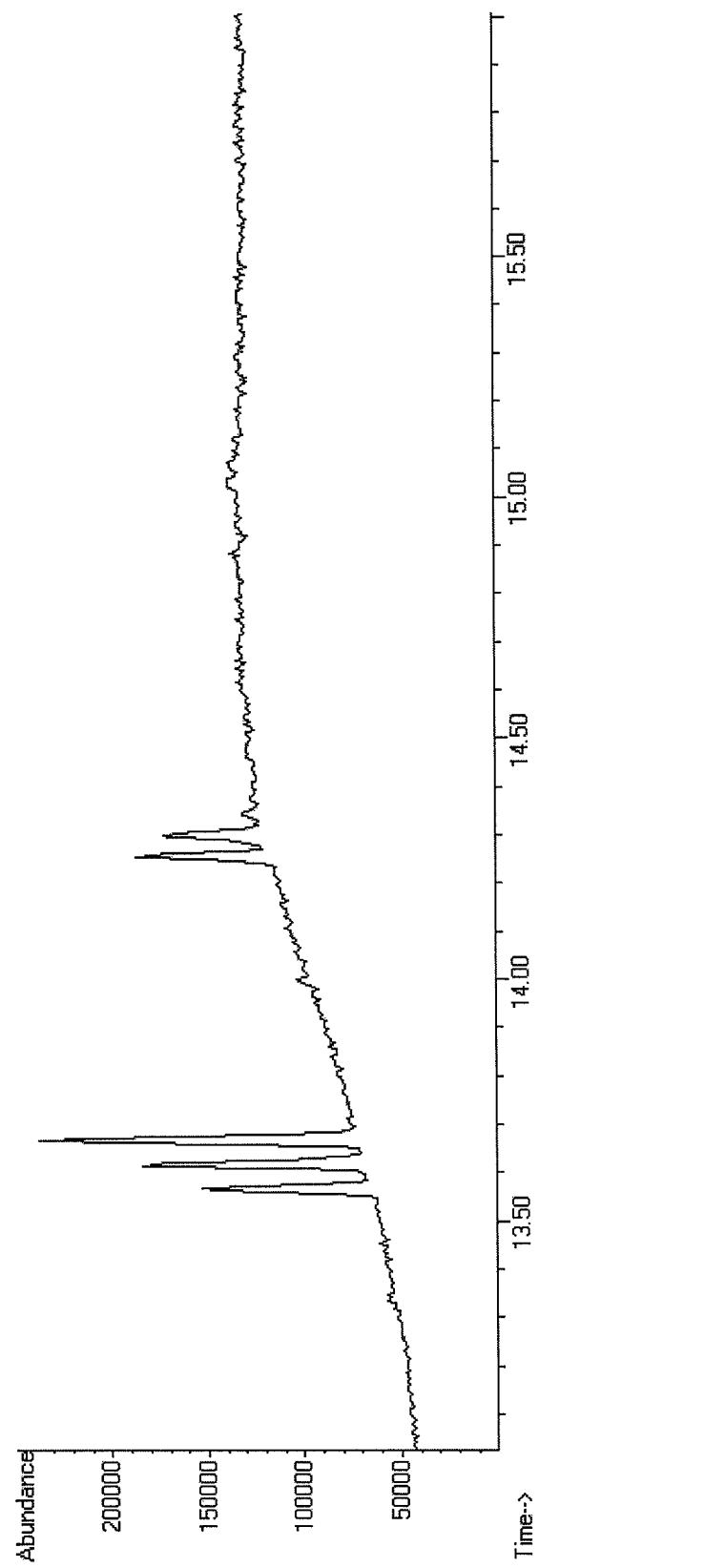
Figure 7B:
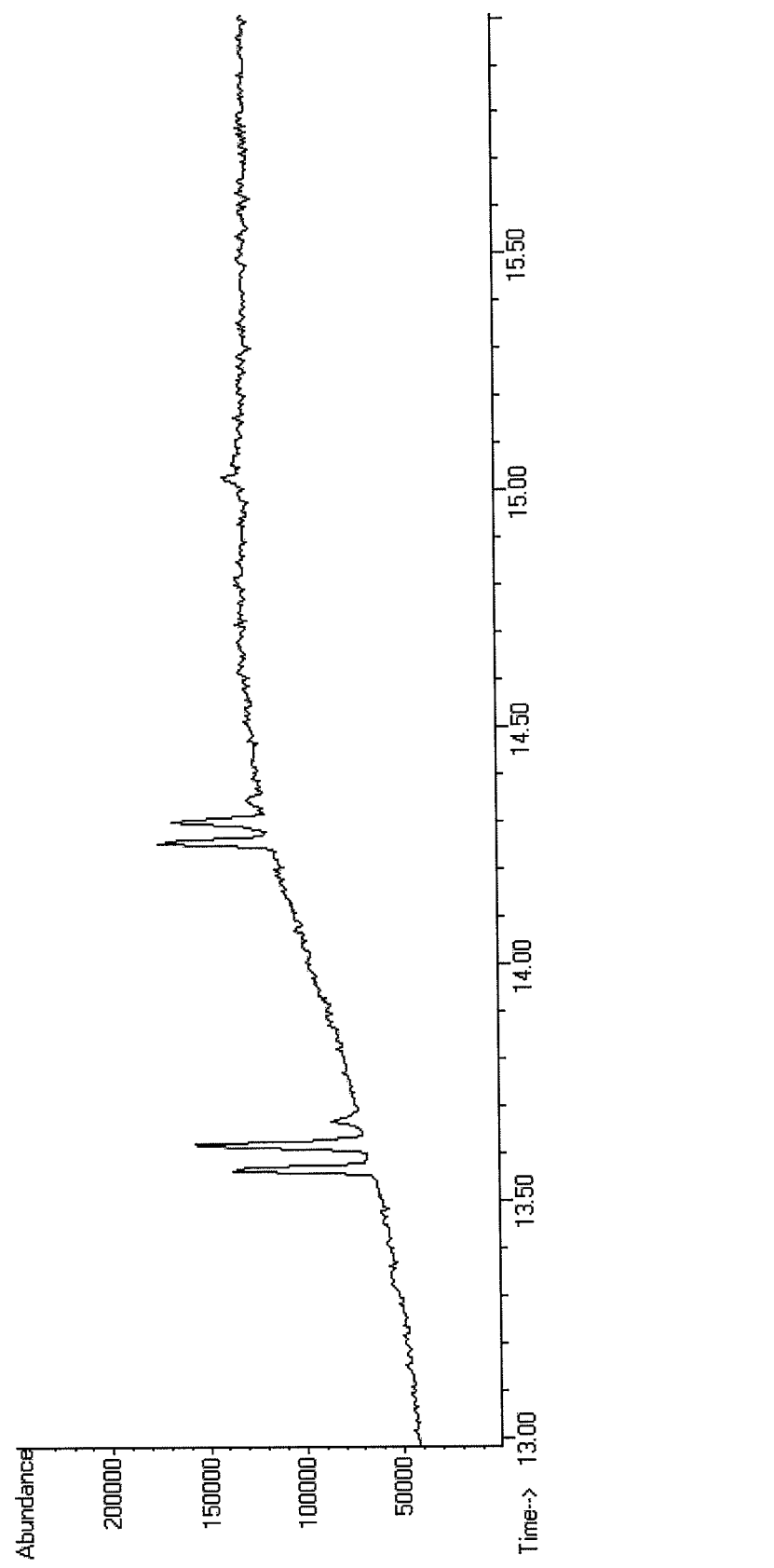

The resulting aliphatic ketones observed by GC/MS and GC/FID were saturated, mono-unsaturated, and di-unsaturated. The aliphatic ketones ranged in carbon chain length from $C_{27}$ to $C_{31}$ (see FIGS. 7A and 7B). The sample containing substrate and OleA-extract was compared to all the other control sample combinations. The production of an increased amount of $C_{27}$ aliphatic ketone relative to all the control samples was indicative of the acyl-condensing activity found in OleA (see FIG. 7C).

The results of the experiments reflected in this example demonstrate that acyl coenzyme A is a substrate for the production of aliphatic ketone in an in vitro assay and that the expression of oleA is required for aliphatic ketone production.

EXAMPLE 5

Figure 8A:
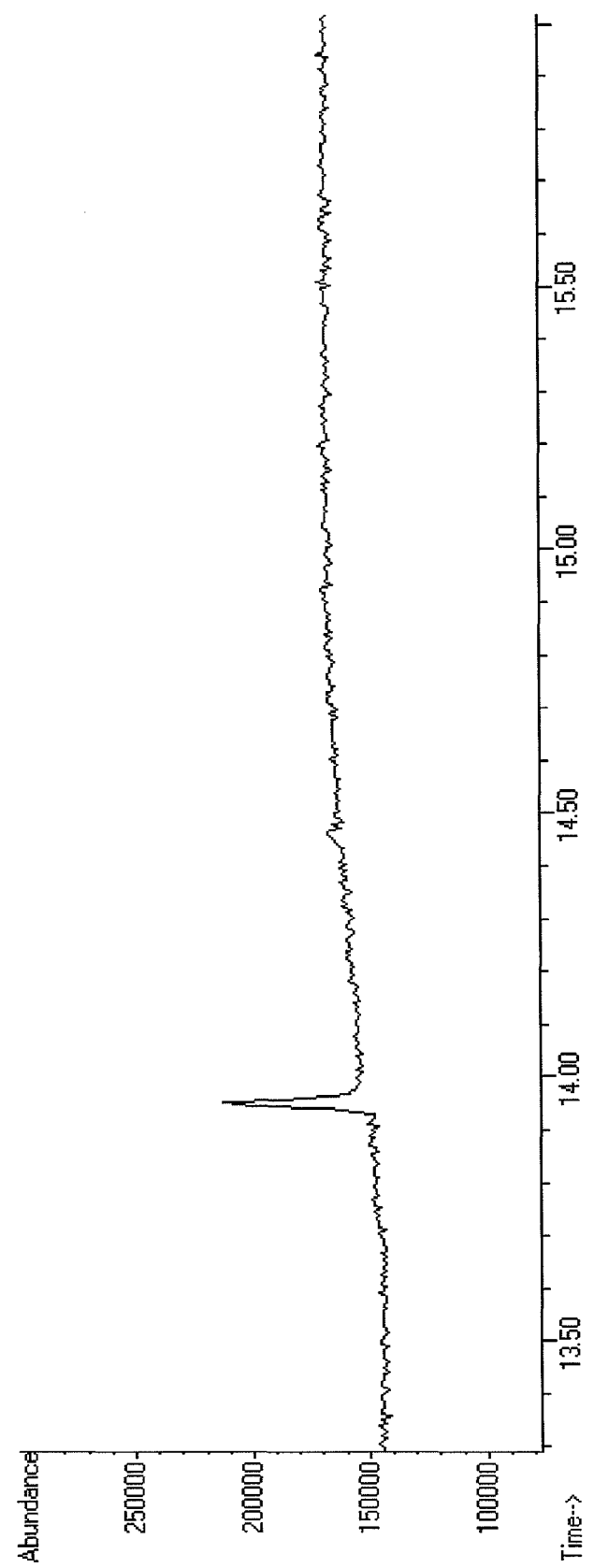
Figure 8B:
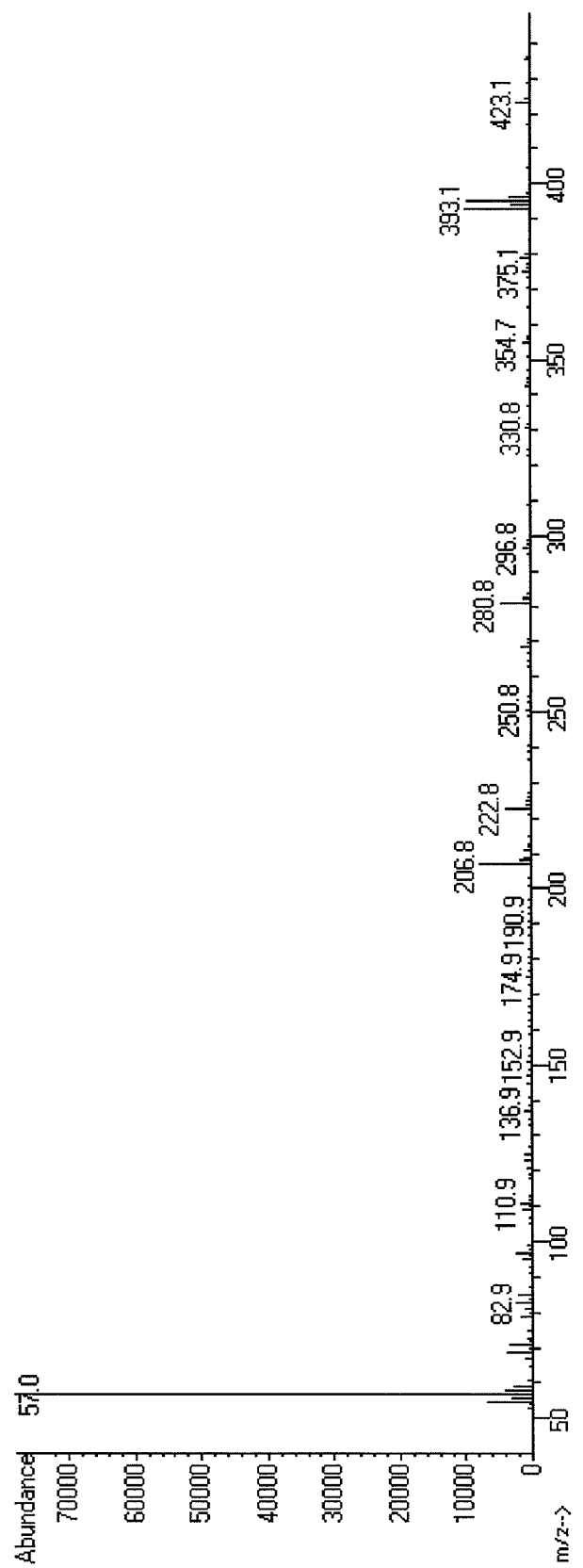

This example demonstrates the ability to observe aliphatic ketones using an in vitro assay combining purified enzyme (e.g., OleA protein) with purified substrate (e.g., acyl-coenzyme A, acyl-ACP, etc.) in a 0.1 M phosphate buffer pH 7.0.

oleA was expressed in *E. coli* as described in Examples 1 and 3. The resulting recombinant bacteria were cultured, induced, pelleted, and used to make purified OleA protein as described in Example 1. The in vitro assay mixture consisted of a substrate (e.g., acyl-coenzyme A, acyl-ACP, or a mixture of acyl-coenzyme A and acyl-ACP) diluted to a final concentration of 0.1 mM to 1 mM, 20 µL of a 0.6 mg/mL solution of purified OleA protein in a 0.1 M phosphate buffer pH 7.0 with 500 mM magnesium chloride. Each assay mixture was incubated at 37° C. for 1 hour. After the incubation period, 250 µL of ethyl acetate was added to each assay mixture and each assay mixture was mixed on a vortex mixer for 10 minutes. The ethyl acetate fraction of the assay mixture was separated from the aqueous phase by centrifugation in a microcentrifuge at 13000 rpm for 5 minutes. 15 µL of the ethyl acetate fraction (the top layer) was transferred into a GC/MS vial to which 1.5 µL of a 0.1 mg/mL solution of hexacosane solution was added as a control spike into each ethyl acetate fraction before each ethyl acetate fraction was analyzed on the GC/MS using chemical ionization detection methods that are well known in the art (see FIG. 8A-B).

Saturated, mono-unsaturated, and di-unsaturated aliphatic ketones were observed with carbon chain lengths ranging from $C_{19}$ to $C_{31}$. Aliphatic ketone was not observed in any of the control assay mixtures (e.g., assay mixtures containing a purified enzyme without a substrate or assay mixtures containing a purified substrate without a purified enzyme).

Tables 16-18 illustrate the combinations of substrates that were tested and the types of aliphatic ketones that were produced. Aliphatic ketones were formed by the following combinations of substrates: acyl-CoA with acyl-CoA, acyl-ACP with acyl-ACP, and acyl-CoA with acyl-ACP (data from each combination are shown in Tables 16, 17, and 18, respectively). The substrates are shown across the top and left side of the table and each entry shows the length of the carbon chain followed by the number of double bonds for each aliphatic ketone that was formed (e.g., C27:1 refers to an aliphatic ketone with 27 carbons and a single double bond, C23 refers to a completely saturated aliphatic ketone with 23 carbons, etc.).

TABLE 16

| | acyl-CoA | | | | |
|---|---|---|---|---|---|
| acyl-CoA | C10 | C12 | C14 | C16 | C16:1 |
| C10 | C19 | N/A | C23 | N/A | N/A |
| C12 | — | C23 | C25 | | C27:1 |
| C14 | — | — | C27 | C29 | C29:1 |
| C16 | — | — | — | C31 | C31:1 |
| C16:1 | — | — | — | — | C31:2 |

N/A = have not been tested.

TABLE 17

| | acyl-ACP | | | | |
|---|---|---|---|---|---|
| acyl-ACP | C10 | C12 | C14 | C14:1 | C16:1 |
| C10 | C19 | N/A | C23 | N/A | N/A |
| C12 | — | C23 | C25 | N/A | C27:1 |
| C14 | — | — | C27 | C27:1 | C29:1 |
| C14:1 | — | — | — | C27:2 | N/A |
| C16:1 | — | — | — | — | C31:2 |

N/A = have not been tested.

TABLE 18

| Substrate | C14-ACP |
|---|---|
| C16:1-CoA | C27, C29:1, C31:2 |

The results of the experiments reflected in this example demonstrate that an in vitro assay can be utilized to detect OleA activity by the presence of aliphatic ketones. In addition, the results of the experiments reflected in this example demonstrate that both acyl-coenzyme A and acyl-ACP can be used as substrates by OleA alone or in combination to produce aliphatic ketones. The chain length and the degree of saturation of the substrate can vary to yield a wide range of aliphatic ketone products.

EXAMPLE 6

This example describes the identification of additional oleA, oleC, and oleD nucleic acid and amino acid sequences using the S. maltophilia nucleic acid and amino acid sequences described herein.

The amino acid sequences of proteins related to the S. maltophilia OleA, OleC, and OleD sequences were determined by using the NCBI BLAST protein alignment program to search the nr database as well as a number of other publicly accessible databases. To demonstrate how to identify and test for the activity of additional members of the oleA, oleC, and oleD gene family, genes from a closely related organism, Xanthomonas axonopodis (oleA, oleC, and oleD) and genes from two distantly related organisms, Chloroflexus aggregans (oleA, oleC, and oleD) and Plesiocystis pacifica (oleC), were cloned and tested as follows.

The plasmids used in this example were made using the same bacterial strains, resistance markers, and PCR techniques described in Example 1. For a more detailed description of the plasmids, see Table 15. Similarly, the 5 mL Fermentation Protocol, Hydrocarbon Extraction Method 1, and the GC/MS Hydrocarbon Detection Method 1 described in Example 1 were used to identify hydrocarbons and hydrocarbon intermediates.

The genes of interest were designed to be optimized for expression in E. coli using the Protein-2-DNA software (see, e.g., Gustafsson et al., Trends Biotechnol. 22: 346-353 (2004)) to select a codon distribution mimicking natural highly expressed E. coli proteins (see, e.g., Henaut et al., Analysis and predictions from E. coli sequences, In E. coli and Salmonella typhimurium Cellular and Molecular Biology, Volume 2, Edited by: Neidhardt et al., Washington D.C., ASM press, pp. 2047-2066 (1996)). The gene(s) were synthesized by non-template PCR similar to what has previously been described in the literature (see, e.g., Dillon et al., Biotechniques, 9: 298-300 (1990)). Gene synthesis was performed by DNA2.0 (Menlo Park, Calif.).

The synthetic open reading frames were cloned into plasmid pJ201 (DNA 2.0, Menlo Park, Calif.). These genes were subcloned into pET21d upstream of the T7 promoter in the multiple cloning site between NcoI and HindIII sites. Primers were designed to conserve the 5' and 3' ends of the protein sequences. The codon optimized version of oleA based on the amino acid sequence from S. maltophilia (SEQ ID NO:3) was PCR amplified from the DNA 2.0 plasmid using the LF305 (SEQ ID NO: 37) and LF306 (SEQ ID NO: 38) primers (see Table 14 for primer sequences). The PCR product was digested with PciI and HindIII and cloned into the pET21d vector. The oleA open reading frame (SEQ ID NO:11) based on the amino acid sequence of Xanthomonas axonopodis GenBank accession # NP_640589.1 GI:21241007 (SEQ ID NO: 12) was PCR amplified from the DNA 2.0 plasmid using primers LF307 (SEQ ID NO: 39) and LF308 (SEQ ID NO: 40). The PCR product was digested with PciI and HindIII and cloned into the pET21d vector. The oleA open reading frame (SEQ ID NO: 17) based on the amino acid sequence of Chloroflexus aggregans DSM 9485 NCBI GenBank accession # ZP_01515932.1 GI:118047293 (SEQ ID NO: 18) was PCR amplified from the DNA 2.0 plasmid using primers LF313 (SEQ ID NO: 41) and LF314 (SEQ ID NO: 42). The PCR product was digested with PciI and HindIII and cloned into the pET21d vector. The synthetic versions of the oleC (SEQ ID NO: 13) and oleD (SEQ ID NO: 15) genes from Xanthomonas axonopodis, the oleC (SEQ ID NO: 19) and oleD (SEQ ID NO: 21) genes from Chloroflexus aggregans, and the oleC gene from Plesiocystis pacifica (SEQ ID NO: 87) were directly subcloned from the DNA 2.0 pJ201 vectors in front of the T7 promoter in the pCOLADuet and pET21d vectors using NcoI and HindIII.

Figure 9:
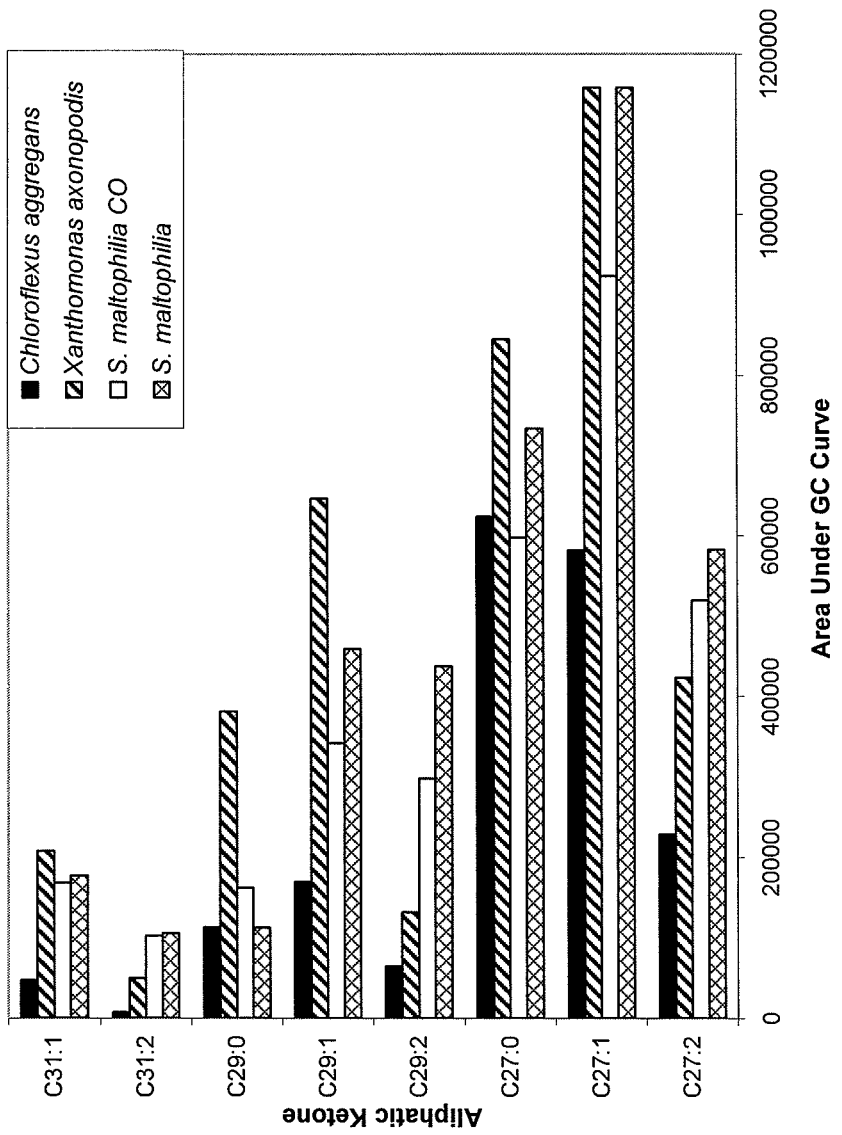

The aliphatic ketone producing activity of OleA from *S. maltophilia*, *Xanthomonas axonopodis*, and *Chloroflexus aggregans* was assessed by detecting aliphatic ketones when the respective OleA was expressed in *E. coli*. *E. coli* C41 (DE3) cells were transformed with the plasmid of interest, and induced using the described T7 expression protocol. Next, the pellets were extracted using Extraction Method 1 and aliphatic ketones were observed by GC/MS Detection Method 1. Similar methods can be used to express OleA from any organism of interest and to subsequently detect aliphatic ketones by GC/MS. The aliphatic ketones observed by GC/MS were saturated, mono-unsaturated, and di-unsaturated which ranged in carbon chain length from $C_{27}$ to $C_{33}$ (see FIG. 9 and Table 19).

The hydrocarbon synthase activities of OleA, OleC, and OleD from *Xanthomonas axonopodis* and *Chloroflexus aggregans* and OleC from *Plesiocystis pacifica* were assessed using a complementation assay testing for olefin production. The activity of OleA from *X. axonopodis* and *C. aggregans* was assessed in an *E. coli* strain that also expressed OleC and OleD from *S. maltophilia*. The activity of OleC was assessed in an *E. coli* strain that also expressed OleA and OleD from *S. maltophilia*. More specifically, to test for OleA hydrocarbon synthase activity, cells were transformed with three plasmids carrying oleA from the organism of interest, oleC (*S. maltophilia*), and oleD (*S. maltophilia*). The transformed cells were then subjected to fermentation, extraction, and GC/MS detection methods.

To test for OleC hydrocarbon synthase activity, cells were transformed with three plasmids carrying oleAB (*S. maltophilia*), oleC from the organism of interest, and oleD (*S. maltophilia*). The addition of OleB to the *E. coli* is optional. The transformed cells were then subjected to fermentation, extraction, and GC/MS detection methods.

To test for OleD hydrocarbon synthase activity, cells were transformed with three plasmids carrying oleAB (*S. maltophilia*), oleC (*S. maltophilia*), and oleD from the organism of interest. The addition of OleB to the *E. coli* is optional. The transformed cells were then subjected to fermentation, extraction, and GC/MS detection methods.

For example, the strains used to assess oleC activity from *C. aggregans*, *X. axonopodis*, and *P. pacifica* were of the following genotypes: *E. coli* C41(DE3) ΔfadE; pCOLADuet_OleAB, pCDFDuet_OleD, pET21d_OleC(Chl). *E. coli* C41(DE3) ΔfadE; pCOLADuet_OleAB, pCDFDuet_OleD, pET21d_OleC(Xan). *E. coli* C41(DE3) ΔfadE; pCOLADuet_OleAB, pCDFDuet_OleD, pET21d_OleC(Ple). The strains used to assess oleD activity from *C. aggregans*, and *X. axonopodis* were of the following genotypes: *E. coli* C41 (DE3) ΔfadE; pCOLADuet_OleAB, pCDFDuet_OleC, pET21d_OleD(Chl). *E. coli* C41(DE3) ΔfadE; pCOLADuet_OleAB, pCDFDuet_OleC, pET21d_OleD (Xan). The strains used to assess oleA activity from *C. aggregans*, and *X. axonopodis* were of the following genotype *E. coli* C41(DE3); ΔfadE; pET21d_OleA(Chl); pACYCDuet_OleCD; pCDFDuet_fadD and, *E. coli* C41(DE3); ΔfadE; pET21d_OleA(Xan); pACYCDuet_OleCD; pCDFDuet_fadD.

To demonstrate that ole genes based solely on the *S. maltophilia* amino acid sequences are not required for hydrocarbon production in *E. coli*, a strain with the oleA, oleC, and oleD genes encoding for the three *X. axonopodis* protein sequences were used to test for hydrocarbon production in *E. coli*. *E. coli* C41(DE3) ΔfadE; pET21d_OleA(Xan), pCOLADuet_OleD(Xan), pCDF_Duet_OleC(Xan) was made and assessed for the ability to produce hydrocarbons. The pellets were then extracted and analyzed for the production of hydrocarbons by GC/MS. The hydrocarbons observed by GC/MS were mono-, di-, and tri-unsaturated olefins which ranged in carbon chain length from $C_{27}$ to $C_{31}$ (Table 19).

The results of the experiments reflected in this example demonstrate that the three related OleA protein sequences from *S. maltophilia*, *Xanthomonas axonopodis*, and *Chloroflexus aggregans* all function to produce aliphatic ketones when expressed in *E. coli* C41(DE3) ΔfadE. The results of the experiments reflected in this example also demonstrate that the OleA protein sequences from *S. maltophilia*, *Xanthomonas axonopodis*, and *Chloroflexus aggregans* all function to produce hydrocarbons when expressed in *E. coli* C41(DE3) ΔfadE expressing known functional oleC and oleD genes. Additionally, the results of the experiments reflected in this example demonstrate that the three related OleC protein sequences from *Xanthomonas axonopodis*, *Chloroflexus aggregans*, and *Plesiocystis pacifica* all function to produce olefins when expressed in *E. coli* C41(DE3) ΔfadE expressing known functional oleA and oleD genes. Similarly, the two related OleD protein sequences from *Xanthomonas axonopodis* and *Chloroflexus aggregans* both function to produce olefins when expressed in *E. coli* C41(DE3) ΔfadE expressing known functional oleA and oleC genes. In addition, ole genes showing activity in combination with other functional ole genes produce hydrocarbons, whether or not they are derived from the same organism. For example, ole genes from *Xanthomonas axonopodis* function together with ole genes derived from *S. maltophilia* to produce hydrocarbons.

TABLE 19

| Protein | Organism | DNA | Aliphatic Ketone | | | | | | | |
|---|---|---|---|---|---|---|---|---|---|---|
| | | | C27 | C27:1 | C27:2 | C29 | C29:1 | C29:2 | C31:1 | C31:2 |
| OleA | S. maltophilia ATCC17679 | native | + | + | + | + | + | + | + | + |
| OleA | S. maltophilia R551-3 | synthetic | + | + | + | + | + | + | + | + |
| OleA | Xanthomonas axonopodis | synthetic | + | + | + | + | + | + | + | + |
| OleA | Chloroflexus aggregans | synthetic | + | + | + | + | + | + | + | + |

| Protein | Organism | DNA | Olefin* | | | | | | | |
|---|---|---|---|---|---|---|---|---|---|---|
| | | | C27:1 | C27:2 | C27:3 | C29:1 | C29:2 | C29:3 | C31:2 | C31:3 |
| OleA | S. maltophilia R551-3 | synthetic | + | + | + | + | + | + | + | + |
| OleA | Xanthomonas axonopodis | synthetic | + | + | + | + | + | + | + | + |

TABLE 19-continued

| | | | | | | | | | | |
|---|---|---|---|---|---|---|---|---|---|---|
| OleA | *Chloroflexus aggregans* | synthetic | + | + | + | + | + | + | + | + |
| OleC | *S. maltophilia* ATCC17679 | native | + | + | + | + | + | + | + | + |
| OleC | *Xanthomonas axonopodis* | synthetic | + | + | + | + | + | + | + | + |
| OleC | *Chloroflexus aggregans* | synthetic | + | + | + | + | + | + | + | + |
| OleC | *Plesiocystis pacifica* | synthetic | + | + | + | + | + | + | + | + |
| OleD | *S. maltophilia* ATCC17679 | native | + | + | + | + | + | + | + | + |
| OleD | *Xanthomonas axonopodis* | synthetic | + | + | + | + | + | + | + | + |
| OleD | *Chloroflexus aggregans* | synthetic | + | + | + | + | + | + | + | + |
| OleACD | *Xanthomonas axonopodis* | synthetic | + | + | + | + | + | + | + | + |

OleC was tested in the presence of OleA and OleD from *S. maltophilia* ATCC17679. OleD was tested in the presence of OleA and OleC from *S. maltophilia* ATCC17679. Ole A was tested in the presence of OleC and OleD from *S. maltophilia* ATCC17679.

This example demonstrates an in vivo assay method for identifying OleA proteins with aliphatic ketone activity. In addition, this experiment demonstrates an in vivo assay method for identifying OleA, OleC and OleD proteins with hydrocarbon synthase activity.

EXAMPLE 7

This example demonstrates that amino acid motifs can be used to identify additional OleA, OleB, OleC, and OleD protein sequences in publicly available databases.

Briefly, programs to search protein databases for specific amino acid patterns (motifs) are available over the Internet. One such program is offered by GenomeNet service through the Kyoto University Bioinformatics Center. The website, as of Aug. 1, 2007, was http://motif.genome.jp/MOTIF2.html.

This motif searching program offers the user the ability to search the following databases: Swiss-Prot, PDBSTR, PIR, PRF, GENES and NR-AA. The user enters the specific amino acid pattern in the PROSITE format (see, e.g., Hofmann et al., *Nucleic Acids Res.* 27: 215-219 (1999)). For example, each residue must be separated by a – (minus); x represents any amino acid; [DE] means either D or E; {FWY} means any amino acid except for F, W, and Y; A(2,3) means that A appears 2 to 3 times consecutively; the pattern string must be terminated with a period. The user selects "search sequence databases for a given pattern," enters a specific amino pattern as described above in the pattern box, and selects the database to be searched.

The motifs provided in Tables 3, 7, and 10 can be used to identify additional OleA proteins. For example, [LF]-X-X-[IVLM]-[ATSV]-G-[IV]-X-[EAHS]-R-R-X-W (SEQ ID NO: 64), which is a motif that defines the OleA protein cluster, was entered in the motif searching program as described above. Exemplary search results for this query are shown below in Table 20.

TABLE 20

Query Pattern: [LF]-X-X-[IVLM]-[ATSV]-G-[IV]-X-[EAHS]-R-R-X-W
Searched in NR-AA database

| Entry Name | Position | Description |
|---|---|---|
| 1. pir:H82615 | 43 ... 55 | [H82615] 3-oxoacyl-[ACP] synthase III XF1970 [imported] - *Xylella fastidiosa* (strain 9a5c)>tr:Q3RAR4_XYLFA [Q3RAR4] 3-oxoacyl-(ACP) synthase III.>tr:Q87D54_XYLFT [Q87D54] 3-oxoacyl-[ACP] synthase III |
| 2. prf:2816338E | 50 ... 62 | 3-oxoacyl-acyl carrier protein synthase - *Photobacterium profundum*>tr:Q93CH0_PHOPR [Q93CH0] 3-oxoacyl-acyl carrier protein synthase III.>gp:AF409100_5 [AF409100] 3-oxoacyl-acyl carrier protein synthase III [*Photobacterium profundum* SS9] |
| 3. prf:3108482HQG | 43 ... 55 | 3-oxoacyl synthase - *Xanthomonas oryzae oryzae*>tr:Q5GV10_XANOR [Q5GV10] 3-oxoacyl-synthase III.>tr:Q2NY94_XANOM [Q2NY94] 3-oxoacyl-[ACP] synthase III. |
| 4. prf:3117429DGF | 43 ... 55 | 3-oxoacyl-acyl carrier protein synthase III-like protein - *Colwellia psychrerythraea*>tr:Q482Y9_COLP3 [Q482Y9] 3-oxoacyl-(Acyl carrier protein) synthase III, homolog.>gp:CP000083_2096 [CP000083] 3-oxoacyl-(acyl carrier protein) synthase III, homolog [*Colwellia psychrerythraea* 34H] |

TABLE 20-continued

| Query Pattern: [LF]-X-X-[IVLM]-[ATSV]-G-[IV]-X-[EAHS]-R-R-X-W Searched in NR-AA database | | |
|---|---|---|
| Entry Name | Position | Description |
| 5. prf:3122281XR | 43 . . . 55 | 3-oxoacyl-acyl carrier protein synthase - *Xanthomonas campestris vesicatoria*>tr:Q3BZ43_XANC5 [Q3BZ43] 3-oxoacyl-[acyl-carrier protein] synthase III (EC 2.3.1.41).>gpu: AM039952_239 [AM039952] 3-oxoacyl-[acyl-carrier protein] synthase III [*Xanthomonas campestris* pv. *vesicatoria* str. 85-10] |
| 6. tr:A0H249_9CHLR | 43 . . . 55 | [A0H249] 3-oxoacyl-(Acyl-carrier protein) synthase (EC 2.3.1.41). |
| 7. tr:A1R7R4_ARTAT | 81 . . . 93 | [A1R7R4] Putative transcriptional regulator, TetR family.>gp:CP000474_2443 [CP000474] putative transcriptional regulator, TetR family [*Arthrobacter aurescens* TC1] |
| 8. tr:A1S4T3_SHEAM | 43 . . . 55 | [A1S4T3] Putative 3-oxoacyl-(Acyl-carrier-protein) synthase III.>gp:CP000507_1177 [CP000507] putative 3-oxoacyl-(acyl-carrier-protein) synthase III [*Shewanella amazonensis* SB2B] |
| 9. tr:A2V0V9_SHEPU | 43 . . . 55 | [A2V0V9] 3-Oxoacyl-(Acyl-carrier-protein (ACP)) synthase III C terminal.>tr:A1RLD2_SHESW [A1RLD2] 3-Oxoacyl-(Acyl-carrier-protein (ACP)) synthase III C terminal domain protein.>tr:A4Y5D7_SHEPU [A4Y5D7] 3-Oxoacyl-(Acyl-carrier-protein (ACP)) synthase III C terminal domain protein. |
| 10. tr:Q0HTF5_SHESR | 43 . . . 55 | [Q0HTF5] 3-Oxoacyl-(Acyl-carrier-protein (ACP)) synthase III C terminal domain protein.>gp:CP000444_2594 [CP000444] 3-Oxoacyl-(acyl-carrier-protein (ACP)) synthase III C terminal domain protein [*Shewanella* sp. MR-7] |
| 11. tr:Q0KY22_9GAMM | 43 . . . 55 | [Q0KY22] Putative 3-oxoacyl-(Acyl-carrier-protein) synthase III. |
| 12. tr:Q1K1K3_DESAC | 43 . . . 55 | [Q1K1K3] Von Willebrand factor, type A. |
| 13. tr:Q3R6U7_XYLFA | 43 . . . 55 | [Q3R6U7] 3-oxoacyl-(ACP) synthase III.>tr:Q3REG9_XYLFA [Q3REG9] 3-oxoacyl-(Acyl-carrier protein) synthase (EC 2.3.1.41). |
| 14. tr:A1R681_ARTAT | 49 . . . 61 | [A1R681] Putative 3-oxoacyl-[ACP] synthase III.>gp:CP000474_1910 [CP000474] putative 3-oxoacyl-[ACP] synthase III [*Arthrobacter aurescens* TC1] |
| 15. tr:A3D2V1_9GAMM | 43 . . . 55 | [A3D2V1] 3-Oxoacyl-(Acyl-carrier-protein (ACP)) synthase III C terminal domain protein.>tr:A4MM52_9GAMM [A4MM52] 3-Oxoacyl-(Acyl-carrier-protein (ACP)) synthase III C terminal domain protein.>tr:A5NBF7_9GAMM [A5NBF7] 3-Oxoacyl-(Acyl-carrier-protein (ACP)) synthase III C terminal domain protein. |
| 16. tr:Q084U7_SHEFN | 43 . . . 55 | [Q084U7] 3-Oxoacyl-(Acyl-carrier-protein (ACP)) synthase III C terminal domain protein.>gp:CP000447_1355 [CP000447] 3-Oxoacyl-(acyl-carrier-protein (ACP)) synthase III C terminal domain protein [*Shewanella frigidimarina* NCIMB 400] |
| 17. tr:Q0HH48_SHESM | 43 . . . 55 | [Q0HH48] 3-Oxoacyl-(Acyl-carrier-protein (ACP)) synthase III C terminal domain protein.>gp:CP000446_2537 [CP000446] 3-Oxoacyl-(acyl-carrier-protein (ACP)) synthase III C terminal domain protein [*Shewanella* sp. MR-4] |
| 18. tr:A0X3V3_9GAMM | 43 . . . 55 | [A0X3V3] 3-Oxoacyl-(Acyl-carrier-protein (ACP)) synthase III C terminal domain protein. |
| 19. tr:A1IES4_9DELT | 43 . . . 55 | [A1IES4] Putative 3-oxoacyl-(Acyl-carrier-protein) synthase III. |
| 20. tr:Q1ZDM4_9GAMM | 43 . . . 55 | [Q1ZDM4] 3-oxoacyl-(Acyl carrier protein) synthase (EC 2.3.1.41). |
| 21. tr:A0J5A0_9GAMM | 43 . . . 55 | [A0J5A0] 3-Oxoacyl-(Acyl-carrier-protein (ACP)) synthase III C terminal. |
| 22. tr:A0KYS3_SHESA | 43 . . . 55 | [A0KYS3] 3-Oxoacyl-(Acyl-carrier-protein (ACP)) synthase III C terminal domain protein.>gp:CP000469_2697 [CP000469] 3-Oxoacyl-(acyl-carrier-protein (ACP)) synthase III C terminal domain protein [*Shewanella* sp. ANA-3] |

TABLE 20-continued

Query Pattern: [LF]-X-X-[IVLM]-[ATSV]-G-[IV]-X-[EAHS]-R-R-X-W
Searched in NR-AA database

| Entry Name | Position | Description |
|---|---|---|
| 23. tr:A1SW97_PSYIN | 43 ... 55 | [A1SW97] 3-Oxoacyl-(Acyl-carrier-protein (ACP)) synthase III C terminal domain protein.>gp:CP000510_1891 [CP000510] 3-Oxoacyl-(acyl-carrier-protein (ACP)) synthase III C terminal domain protein [*Psychromonas ingrahamii* 37] |
| 24. tr:A5CT00_CLAM3 | 51 ... 63 | [A5CT00] Putative 3-oxoacyl-[acyl-carrier-protein] synthase (EC 2.3.1.41).>gp:AM711867_2161 [AM711867] putative 3-oxoacyl-[acyl-carrier-protein] synthase [*Clavibacter michiganensis* subsp. *michiganensis* NCPPB 382] |
| 25. tr:Q12PH1_SHEDO | 43 ... 55 | [Q12PH1] Putative 3-oxoacyl-(Acyl-carrier-protein) synthase III.>gp:CP000302_1358 [CP000302] putative 3-oxoacyl-(acyl-carrier-protein) synthase III [*Shewanella denitrificans* OS217] |
| 26. tr:Q1YZ92_PHOPR | 43 ... 55 | [Q1YZ92] 3-oxoacyl-(Acyl carrier protein) synthase (EC 2.3.1.41). |
| 27. tr:A1ATM6_PELPD | 43 ... 55 | [A1ATM6] 3-Oxoacyl-(Acyl-carrier-protein (ACP)) synthase III C terminal domain protein.>gp:CP000482_3055 [CP000482] 3-Oxoacyl-(acyl-carrier-protein (ACP)) synthase III C terminal domain protein [*Pelobacter propionicus* DSM 2379] |
| 28. tr:A4A9J6_9GAMM | 49 ... 61 | [A4A9J6] 3-oxoacyl-[acyl-carrier-protein] synthase III. |
| 29. tr:A5GFJ5_9DELT | 43 ... 55 | [A5GFJ5] 3-Oxoacyl-(Acyl-carrier-protein (ACP)) synthase III C terminal domain protein.>gp:CP000698_1982 [CP000698] 3-Oxoacyl-(acyl-carrier-protein (ACP)) synthase III C terminal domain protein [*Geobacter uraniumreducens* Rf4] |
| 30. tr:A0W5R8_9DELT | 43 ... 55 | [A0W5R8] 3-Oxoacyl-(Acyl-carrier-protein (ACP)) synthase III C terminal. |
| 31. tr:A3QDN2_SHELP | 43 ... 55 | [A3QDN2] 3-Oxoacyl-(Acyl-carrier-protein (ACP)) synthase III C terminal domain protein.>gp:CP000606_1707 [CP000606] 3-Oxoacyl-(acyl-carrier-protein (ACP)) synthase III C terminal domain protein [*Shewanella loihica* PV-4] |
| 32. tr:A3ZXB5_9PLAN | 43 ... 55 | [A3ZXB5] 3-oxoacyl-(Acyl carrier protein) synthase (EC 2.3.1.41). |
| 33. tr:Q3DYP6_CHLAU | 43 ... 55 | [Q3DYP6] 3-oxoacyl-(ACP) synthase III. |
| 34. tr:A1FUB4_XANMA | 43 ... 55 | [A1FUB4] 3-oxoacyl-(Acyl carrier protein) synthase (EC 2.3.1.41). |
| 35. tr:A4LZ02_9DELT | 43 ... 55 | [A4LZ02] 3-Oxoacyl-(Acyl-carrier-protein (ACP)) synthase III C terminal domain protein. |
| 36. tr:Q0YLU4_9DELT | 43 ... 55 | [Q0YLU4] Putative 3-oxoacyl-(Acyl-carrier-protein) synthase III. |
| 37. tr:Q40YV3_KINRA | 87 ... 99 | [Q40YV3] Similar to 3-oxoacyl-(Acyl-carrier-protein). |
| 38. tr:A6G0Q4_9DELT | 43 ... 55 | [A6G0Q4] 3-oxoacyl-(Acyl carrier protein) synthase (EC 2.3.1.41). |
| 39. tr:Q8EG66_SHEON | 43 ... 55 | [Q8EG66] Putative uncharacterized protein.>gp:AE014299_1709 [AE014299] conserved hypothetical protein [*Shewanella oneidensis* MR-1] |
| 40. tr:Q7UI20_RHOBA | 79 ... 91 | [Q7UI20] 3-oxoacyl-[ACP] synthase III (EC 2.3.1.41).>gp:BX294155_248 [BX294155] 3-oxoacyl-[ACP] synthase III [*Rhodopirellula baltica* SH 1] |
| 41. tr:Q6LS53_PHOPR | 38 ... 50 | [Q6LS53] 3-oxoacyl-acyl carrier protein synthase III.>gp:CR378667_231 [CR378667] 3-oxoacyl-acyl carrier protein synthase III [*Photobacterium profundum* SS9] |
| 42. tr:Q4V064_XANC8 | 43 ... 55 | [Q4V064] 3-oxoacyl-[ACP] synthase III.>tr:Q8PDX2_XANCP [Q8PDX2] 3-oxoacyl-[ACP] synthase III.>gp:CP000050_215 [CP000050] 3-oxoacyl-[ACP] synthase III [*Xanthomonas campestris* pv. *campestris* str. 8004] |
| 43. tr:Q8PQT8_XANAC | 43 ... 55 | [Q8PQT8] 3-oxoacyl-[ACP] synthase III.>gp:AE011648_4 [AE011648] 3-oxoacyl-[ACP] synthase III [*Xanthomonas axonopodis* pv. *citri* str. 306] |

TABLE 20-continued

Query Pattern: [LF]-X-X-[IVLM]-[ATSV]-G-[IV]-X-[EAHS]-R-R-X-W
Searched in NR-AA database

| Entry Name | Position | Description |
| --- | --- | --- |
| 44. tr:Q6AQA3_DESPS | 44 ... 56 | [Q6AQA3] Probable 3-oxoacyl-[acyl-carrier-protein] synthase III.>gp:CR522870_741 [CR522870] probable 3-oxoacyl-[acyl-carrier-protein] synthase III [*Desulfotalea psychrophila* LSv54] |
| 45. gpu:CP000750_1676 | 65 ... 77 | [CP000750] 3-Oxoacyl-(acyl-carrier-protein (ACP)) synthase III domain protein [*Kineococcus radiotolerans* SRS30216] |

Similarly, the motifs provided in Tables 4, 9, and 12 can be used to identify additional OleD enzymes having hydrocarbon synthase activity. These motifs can also be used to identify OleD enzymes having dehydrogenase activity. The motifs provided in Tables 5, 8, and 11 can be used to identify additional OleC enzymes having hydrocarbon synthase activity. The motifs provided in Table 6 can be used to identify additional OleB enzymes having hydrocarbon synthase activity.

The results of this example demonstrate that amino acid motifs for OleA, OleB, OleC, and OleD can be used to identify additional OleA, OleB, OleC, and OleD amino acid sequences. A person of ordinary skill in the art using the OleA, OleB, OleC, and OleD amino acid sequences would also be able to identify the corresponding oleA, oleB, oleC, and oleD genes which encode for the corresponding amino acid sequence. More specifically, these results demonstrate that SEQ ID NOs: 64-74 and 91-133 can be used to search databases to identify additional OleA, OleB, OleC, and OleD enzymes.

EXAMPLE 8

This example demonstrates that expression of OleA in cells in which the fatty acid biosynthetic pathway is altered results in enhanced production of aliphatic ketones.

OleA was expressed in a variety of *E. coli* cells as described in Examples 1 and 3. The resulting recombinant bacteria were cultured, induced, pelleted, and extracted using fermentation Method 2, Extraction Method 1, and Detection Method 1. The aliphatic ketones observed by GC/MS were saturated, mono-unsaturated, and di-unsaturated which ranged in carbon chain length from $C_{27}$ to $C_{31}$.

Eight different *E. coli* hosts were tested:
(1) wild type *E. coli* C41(DE3);
(2) *E. coli* C41(DE3) ΔfadE, which has a complete deletion of the acyl-CoA dehydrogenase fadE;
(3) *E. coli* C41(DE3) with a plasmid which expresses fadD upon induction with IPTG;
(4) *E. coli* C41(DE3) ΔfadE with a plasmid which expresses fadD upon induction with IPTG;
(5) *E. coli* C41(DE3) with a plasmid which expresses 'tesA, a truncated version of the tesA thioesterase A gene, upon induction with IPTG;
(6) *E. coli* C41(DE3) ΔfadE with a plasmid which expresses 'tesA, a truncated version of the tesA thioesterase A gene, upon induction with IPTG;
(7) *E. coli* C41(DE3) with both 'tesA and fadD contained on individual plasmids which are expressed upon induction with IPTG; and
(8) *E. coli* C41(DE3) ΔfadE with both 'tesA and fadD contained on individual plasmids which are expressed upon induction with IPTG.

The plasmids (e.g., fadD and 'tesA) that alter the production of fatty acid pathway intermediates were made using standard molecular biology methods. All the cloned genes were put under the control of IPTG-inducible promoters (e.g., T7, tac or lac promoters). The 'tesA gene (SEQ ID NO: 25; thioesterase A gene accession NP 415027 without leader sequence (Cho et al., *J. Biol. Chem.*, 270: 4216-9 (1995), EC: 3,1,1,5,3.1.2,-)) of *E. coli* was cloned into NdeI/AvrII digested pETDuet-1 (pETDuet-1, described herein, is available from EMD Chemicals, Inc., San Diego, Calif.).

The fadD gene (SEQ ID NO: 492) encoding acyl-CoA synthase from *E. coli* was cloned into a NcoI/HindIII digested pCDFDuet-1. Table 15 provides a summary of the plasmids generated to make several exemplary production strains. One of ordinary skill in the art will appreciate that different plasmids and genomic modifications can be used to achieve similar strains.

Figure 10:
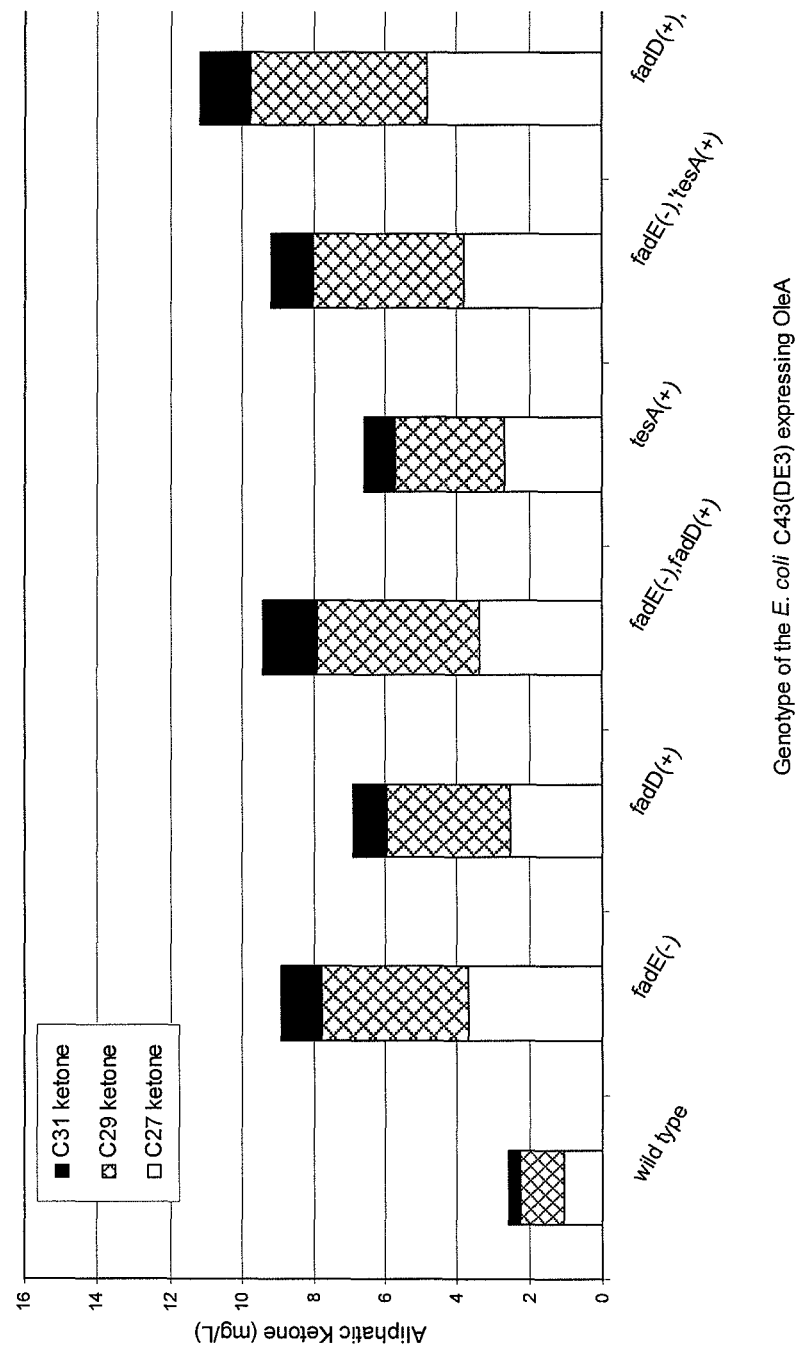

Aliphatic ketone production was increased when oleA was expressed in each of the *E. coli* strains with different alterations in fadE, fadD, and/or tesA described above (see FIG. 10). For example, overexpression of *E coli* 'tesA (pETDuet-1-'tesA) in one system achieved a 2.6 fold increase in aliphatic ketone production when compared to *E. coli* C41(DE3) expressing OleA protein. In another example, expression of oleA in the strain that combines the overexpression of *E. coli* 'tesA and fadD with a deletion of fadE achieved a 5 fold increase in aliphatic ketone production when compared to *E. coli* C41(DE3) expressing OleA protein.

The results of this example demonstrate the ability to observe increases in aliphatic ketones produced by bacterial cells expressing oleA in combination with alterations in genes involved in the fatty acid biosynthetic pathway of the cell.

EXAMPLE 9

This example demonstrates that expression of oleA, oleC, and oleD in cells in which the fatty acid biosynthetic pathway has been altered results in enhanced production of olefins.

oleA, oleC, and oleD were expressed in the *E. coli* strains described in Example 8. The resulting recombinant bacteria were cultured, induced, pelleted, and extracted using Fermentation Method 2, Extraction Method 1, and Detection Method 1. The resulting olefins observed by GC/MS were mono-unsaturated, di-unsaturated, and tri-unsaturated which ranged in carbon chain length from $C_{27}$ to $C_{31}$.

Figure 11:
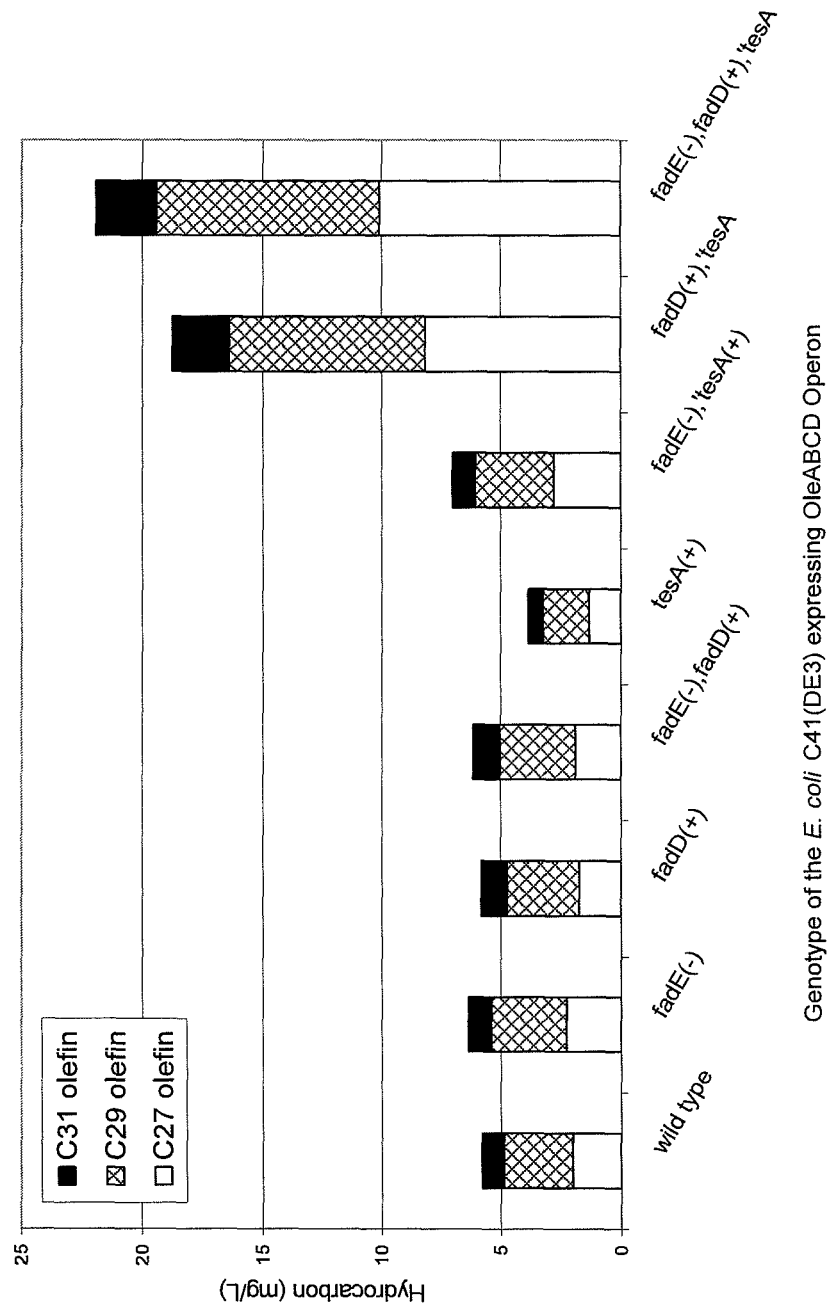
Figure 12A:
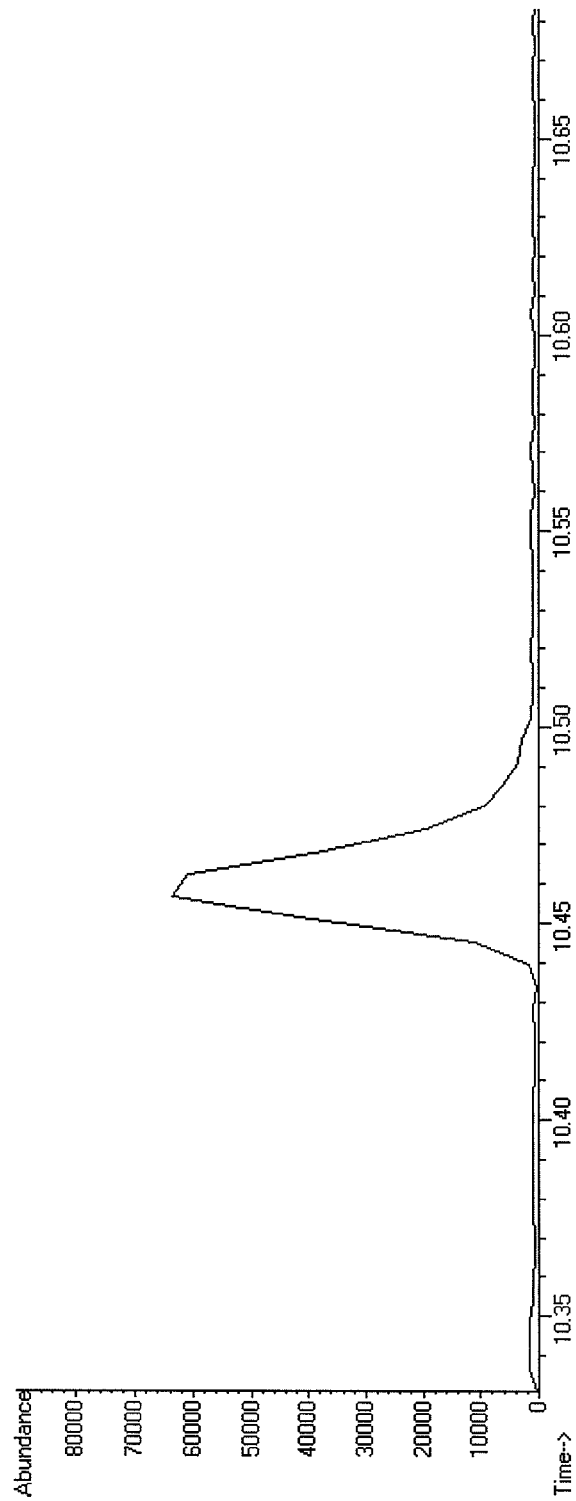
Figure 12B:
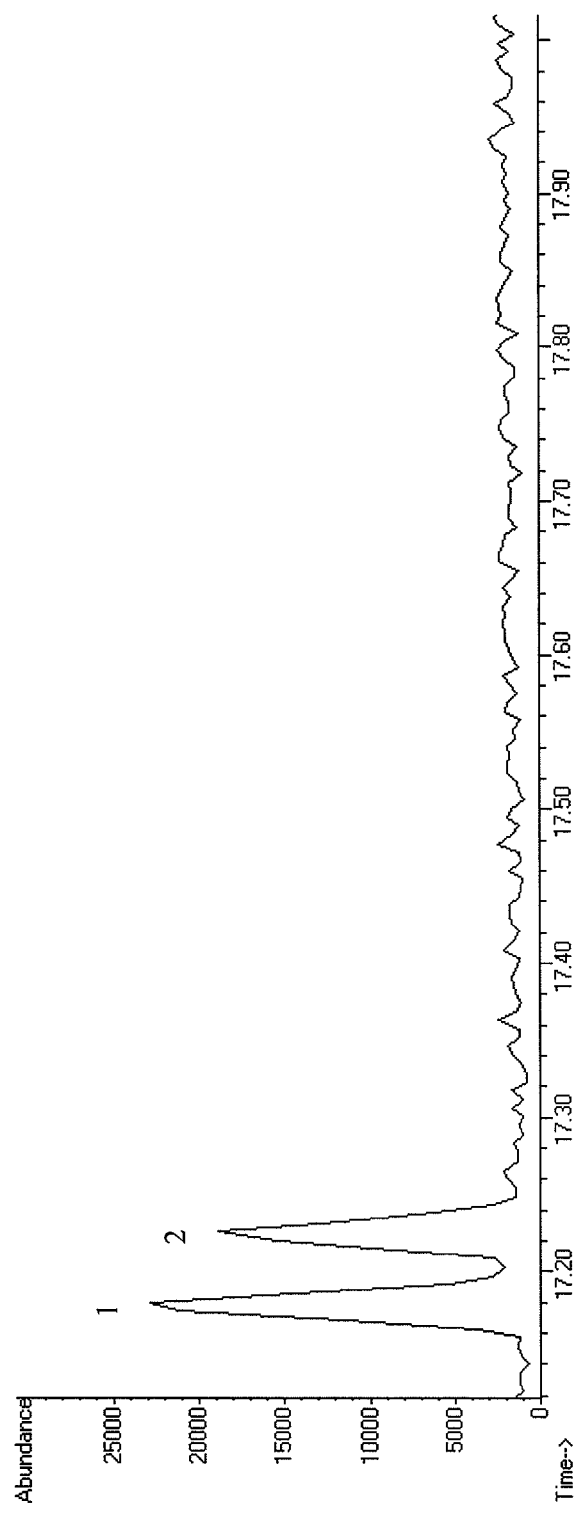
Figure 12C:
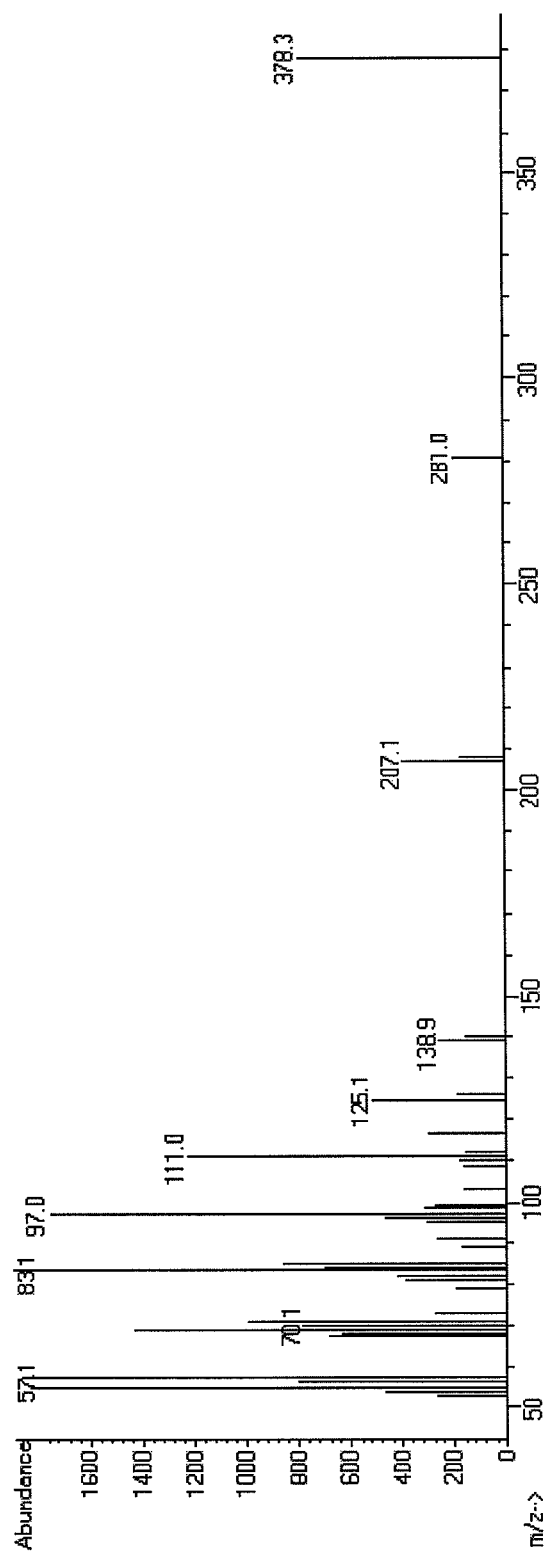
Figure 12D:
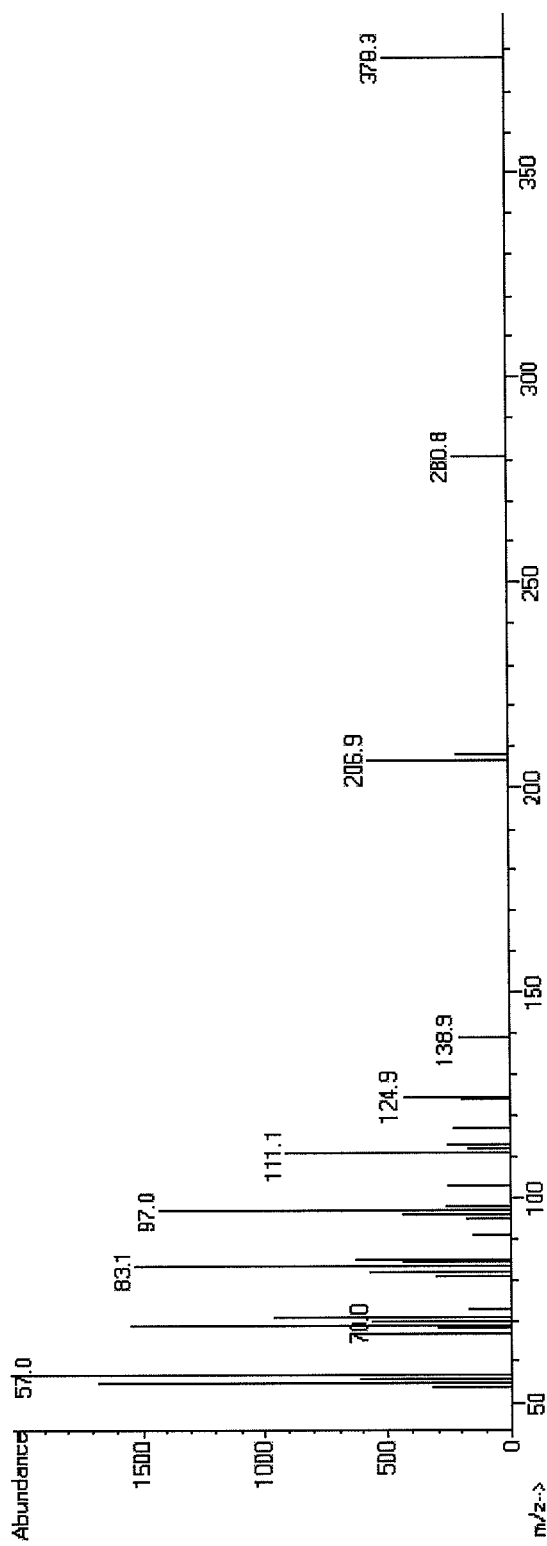
Figure 12E:
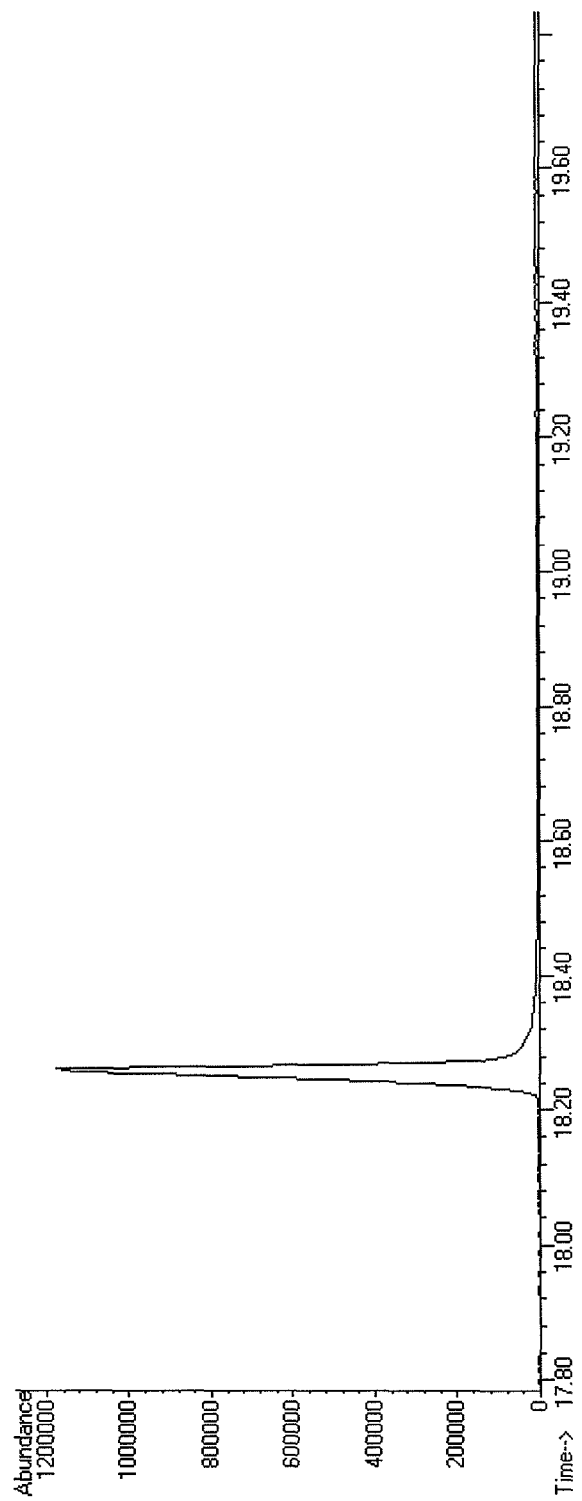

The expression of oleA, oleC, and oleD in *E. coli* strains which combine the overexpression of 'tesA and fadD with a deletion of fadE resulted in a four-fold increase in the amount of olefins observed compared to *E. coli* strain expressing oleA, oleC, and oleD in the wild type *E. coli* background (see FIG. 11).

The results of the experiments reflected in this example demonstrate that significantly increased amounts of olefins are observed in cells in which oleA, oleC, and oleD are expressed in combination with alterations in the fatty acid biosynthetic pathway.

EXAMPLE 10

This example demonstrates that aldehydes, aliphatic ketones, and olefins are observed in an in vitro assay containing OleA and OleD.

His-tagged OleA and OleD proteins were expressed in *E. coli* C41(DE3) ΔfadE using overnight express instant TB medium according to the manufacturer's protocol (Novagen, CA). The proteins were purified using His Bind column chromatography using 500 mM NaCl, 20 mM Tris-HCl, 5 mM imidazole pH 7.9, and 1 mM Tris(hydroxypropyl) phosphine (THP) (1× binding buffer). This was followed by 500 mM NaCl, 60 mM imidazole, 20 mM Tris-HCl pH 7.9, and 1 mM THP (1× wash buffer) according to the instructions in User protocol TB054 Rev. F0106 (Novagen of EMD Chemicals, Inc., San Diego, Calif.). OleA protein was eluted from the His-bind columns using 1 M imidazole, 0.5 M NaCl, and 20 mM Tris-HCl pH 7.9. OleD protein was eluted from the His-bind column using 0.5 M NaCl, 100 mM EDTA, and 20 mM Tris-HCl pH 7.9. All the proteins were buffer exchanged into 50 mM Tris pH 7.5, 100 mM NaCl, 1 mM THP, and 10% glycerol using PD-10 columns according to the manufacturer's protocol (GE Healthcare, NJ).

The purified, His-tagged, OleA and OleD proteins were used in an in vitro assay. The in vitro assay reaction contained 1 mM myristoyl coenzyme A, 10 mM $MgCl_2$, 2.3 μM OleA, 2.4 μM OleD, 10 mM NADPH, and 100 mM phosphate buffer (pH 7.0) in a total volume of 100 μL. The NADPH used in the assay was obtained from Sigma (N7505, St Louis Mo.) and prepared as a 100 mM stock solution in 50 mM Tris pH 7.5. Samples were incubated at 37° C. for 1 hour. The reaction was quenched with 500 μL of ethyl acetate containing 1% acetic acid. The mixture was mixed by vortexing followed by centrifugation. The top layer (ethyl acetate layer) was transferred to a clean glass tube and dried under vacuum in a centrifuge (Vacufuge 5301, Eppendorf, Westbury, N.Y.). The sample was resuspended in 40 μL of ethyl acetate and 104 of 0.1 mg/mL solution of hexacosane (prepared in ethyl acetate), which acted as a control spike, and analyzed by GC/MS (Run Time: 37.33 minutes; Column: HP-5-MS (5% diphenyl siloxane, 95% dimethyl siloxane) Part No. 19091S-433E, Length: (meters) 30, Internal diameter: (mm) 0.25 narrowbore, Film: (μM) 0.25; MSD Scan Range: 50-550 m/z; Inject: 1 μL Agilent 6890 N inlet; Inlet: 300° C. splitless; Carrier gas: Helium (flow rate: 1.3 mL/min); Oven Temp: 3 minute hold at 60° C.; 15° C./minute to 320° C.; 17 minute hold 320° C.; Det: Agilent 5975B XL EI/CI MSD; Det. Temp: 300° C.). Between 1 and 10 μL were analyzed for hydrocarbon content.

The resulting aldehydes, ketones, and olefins detected by GC/MS were tetradecanal, 14-heptacosanone, and isomers of heptacosene (see FIG. 12A-E). The compounds were identified based on retention time and MS spectral profiles.

The results of the experiment reflected in this example demonstrate the ability to observe aldehydes, aliphatic ketones, and olefins using OleA and OleD in an in vitro assay. Specifically, these results demonstrate that aldehydes, aliphatic ketones, and olefins are observed after incubation of OleA and OleD in the presence of myristoyl coenzyme A, $MgCl_2$, and NADPH in an in vitro assay.

EXAMPLE 11

This example demonstrates that the amount of aldehydes and olefins observed in an in vitro assay comprising an acyl coenzyme A substrate, OleA, and OleD is significantly enhanced when purified OleB protein is added to the in vitro assay.

His-tagged OleA and OleD proteins were expressed and purified using His Bind column chromatography as described in Example 10. His-tagged OleB proteins were expressed and purified using the method described in Example 10. The OleA and OleB proteins were eluted from the His-bind columns using 1 M imidazole, 0.5 M NaCl, and 20 mM Tris-HCl pH 7.9. The OleD protein was eluted from the His-bind column using 0.5 M NaCl, 100 mM EDTA, and 20 mM Tris-HCl pH 7.9. All the proteins were buffer exchanged into 50 mM Tris pH 7.5, 100 mM NaCl, 1 mM THP, and 10% glycerol using PD-10 columns according to the manufacturer's protocol (GE Healthcare, NJ).

The purified, His-tagged OleA, OleD, and OleB proteins were used in an in vitro assay. The in vitro assay reaction contained 1 mM myristoyl coenzyme A, 10 mM $MgCl_2$, 2.3 μM OleA, 2.4 μM OleD, 2.3 μM OleB, 10 mM NADPH, and 100 mM phosphate buffer (pH 7.0) in a total volume of 100 μL. Samples were incubated at 37° C. for 1 hour. The reaction was quenched with 500 μL of ethyl acetate containing 1% acetic acid. The mixture was mixed by vortexing followed by centrifugation. The top layer (ethyl acetate layer) was transferred to a clean glass tube and dried under vacuum in a centrifuge (Vacufuge 5301, Eppendorf, Westbury, N.Y.). The sample was resuspended in 40 μL of ethyl acetate and 10 μL of 0.1 mg/mL solution of hexacosane (prepared in ethyl acetate), which acted as a control spike, and analyzed by GC/MS. Between 1 and 10 μL were analyzed for the amount of aldehydes, aliphatic ketones, and olefins present.

Figure 13A:
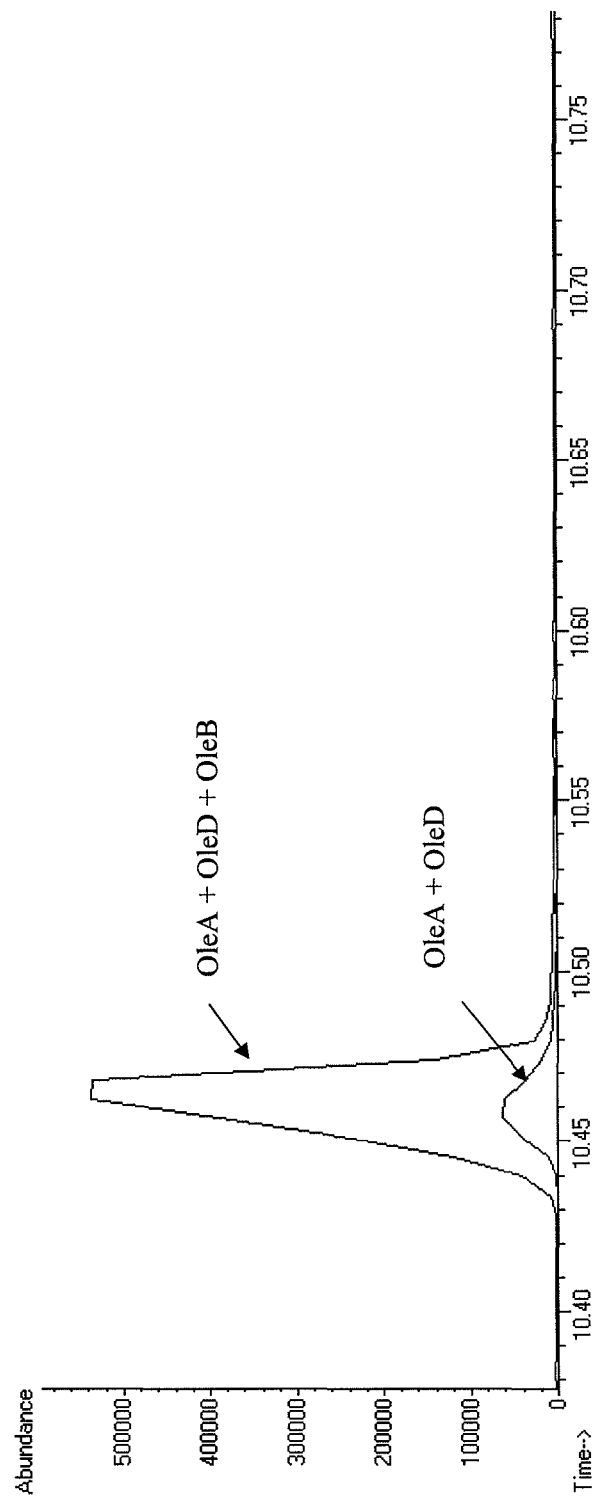
Figure 13B:
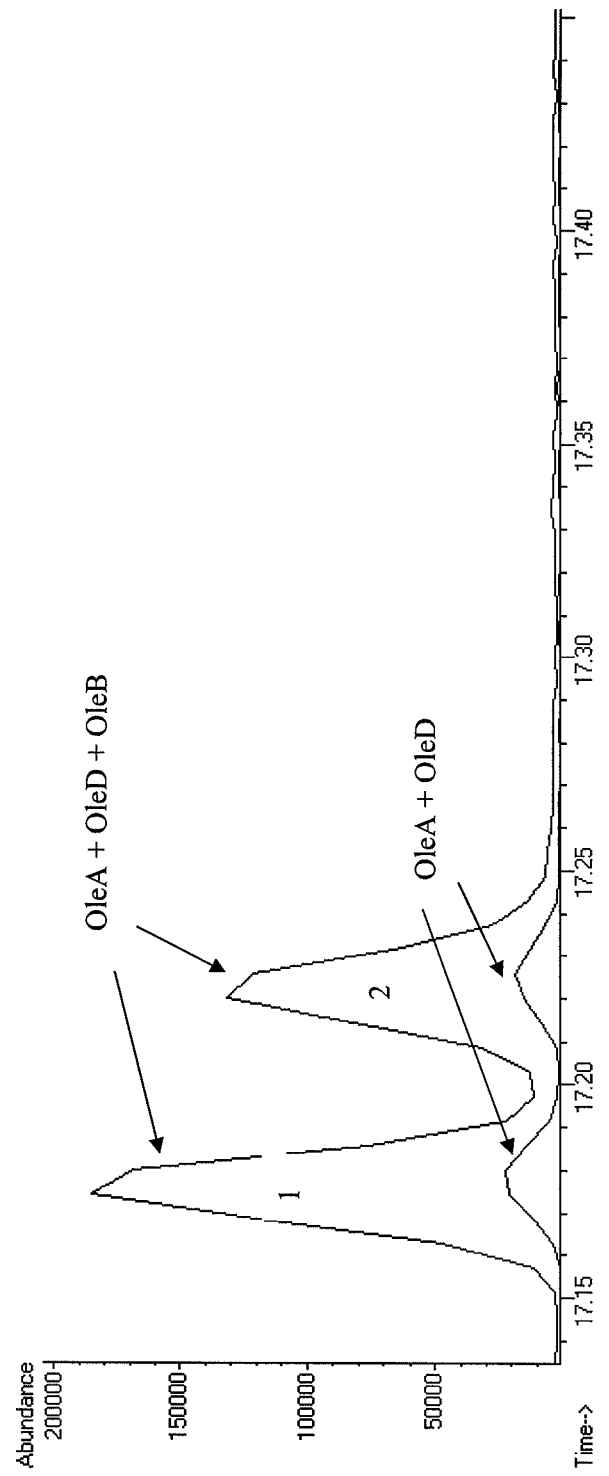
Figure 13C:
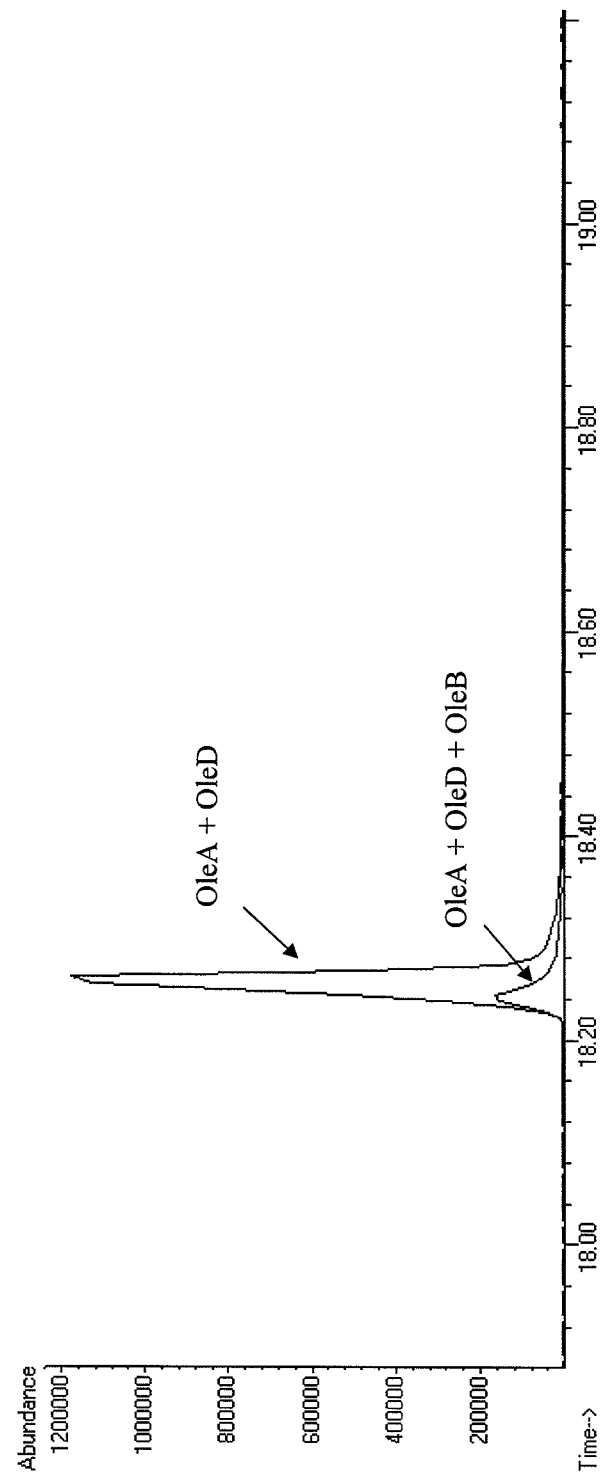

The resulting aldehydes, aliphatic ketones, and olefins detected by GC/MS were tetradecanal, 14-heptacosanone, and isomers of heptacosene (see FIG. 13A-C). The compounds were identified based on retention time and MS spectral profiles. The area under the peak (AP) for each compound was assessed using MSD ChemStation software (Agilent technologies). The relative values were calculated by normalizing each of the reaction products produced by OleA/OleD to 1.0 (e.g., aldehyde produced by OleA+OleD+OleB=AP (OleA+OleD+OleB reaction)/AP (OleA+OleD reaction)). The relative values of aldehyde, olefins, and aliphatic ketones produced by OleA+OleD and OleA+OleD+OleB are shown in Table 21.

TABLE 21

| | | Olefins | | |
|---|---|---|---|---|
| Reaction | Aldehyde | C27:1 Olefin 1 | C27:1 Olefin 2 | Aliphatic Ketone |
| OleA + OleD | 1 | 1 | 1 | 1 |
| OleA + OleD + OleB | 8.3 | 8.2 | 8.2 | 0.2 |

The results of the experiment reflected in this example demonstrate that the amount of aldehyde or olefin observed in an in vitro assay comprising OleA, OleD, and OleB is higher than the amount of aldehyde or olefin observed in an in vitro assay comprising OleA and OleD.

EXAMPLE 12

This example demonstrates that fatty acids can be converted to olefins by bacteria expressing an acyl-CoA synthase gene in combination with the olefin synthase genes (oleA, oleB, oleC, and oleD).

The acyl-CoA synthase gene converts free fatty acids to activated fatty acyl-CoAs, one of the substrates for the olefin synthase genes. A number of different host strains transformed with an acyl-CoA synthase gene. The olefin synthase genes were used in a series of bioconversion experiments. All host strains yielded similar results and were produced using standard molecular biology techniques with the plasmids described in Example 1. The following host strains were used to generate the data shown in this example:

Host 1: E. coli MG1655 ΔfadE transformed with the olefin synthase operon pCL1920pTrcOleABpTrcOleCD (SEQ ID NO: 78) and the acyl-CoA synthase FadD overexpression plasmid pACYCpTrcFadD.

Host 2: E. coli C41 (DE3) ΔfadE transformed with the olefin synthase operon pCL1920pTrcOleABpTrcOleCD (SEQ ID NO: 78) and the acyl-CoA synthase FadD overexpression plasmid pETDuetFadD.

Bioconversion experiments were performed using the 25 mL fermentation procedure described in Example 1. At the time of induction, free fatty acids were added to the culture medium to a final concentration between 0.01% and 0.05% weight by volume fatty acid. The 1 mL whole cell culture method was used to extract the hydrocarbons. The products were analyzed using GC/MS as described in Example 1.

The hydrocarbons detected by GC/MS were mono-, di-, and tri-unsaturated chains that ranged from $C_{19}$ to $C_{33}$. The type of fatty acid substrates added to the fermentations and the olefins products that were detected are shown in Table 22. The amount and type of olefin detected varied depending on the type of fatty acid substrate that was added to the culture medium. This is most notable when the strains produce olefins that are not detected in the control strain, which was not fed. For example, Table 22 shows that a C10 fatty acid is converted into a C19:1 olefin, which would reflect the condensation of two C10 fatty acyl-CoA molecules. C23:1 and C23:2 olefins are also formed. This reflects the condensation of the C10 fatty acyl-CoA with a C14:0 or C14:1 fatty acyl-activated ester, which are naturally produced by the E. coli host strain. Longer chain olefins such as C31:3 are formed when the cell converts C16:1 fatty acids to olefins. When non-native fatty acid substrates were fed, such as the odd chain fatty acids C13, C15, and C17, unique even chain olefins of C26, C28, and C30 were detected. This suggests that the exogenous fatty acids are being converted into olefins.

TABLE 22

| Olefin Produced (mg/L/OD) | Feeding of fatty acids of different chain length | | | | | | | | | |
|---|---|---|---|---|---|---|---|---|---|---|
| | None | C10 | C12 | C13 | C14 | C15 | C17 | C14:1 | C16:1* | C18:1 |
| 019:1 | | 0.32 | | | | | | | | |
| 023:2 | | 0.60 | | | | | | | | |
| 023:1 | | 0.44 | 0.82 | | | | | | | |
| 025:2 | | 0.73 | 0.82 | 0.01 | 0.02 | | | | 0.11 | 0.06 |
| 025:1 | | 0.30 | 0.50 | 1.37 | 0.10 | | | 0.34 | | 0.04 |
| 026:2 | | | | 1.05 | | | | | | |
| 026:1 | | | | 0.72 | | | | | | |
| 027:3 | 0.60 | 0.15 | 0.17 | 0.33 | 0.18 | 0.44 | 0.40 | 2.20 | 0.31 | 0.85 |
| 027:2 | 0.97 | 0.29 | 0.84 | 0.46 | 2.33 | 0.40 | 0.43 | 13.72 | 0.62 | 1.50 |
| 027:1 | 0.28 | 0.14 | 0.44 | 0.35 | 5.29 | 0.35 | 0.10 | | 0.12 | 0.51 |
| 028:2 | | | | 0.76 | | 0.60 | | | | |
| 028:1 | | | | 0.55 | | 0.26 | | | | |
| 029:3 | 0.46 | 0.17 | 0.23 | 0.42 | 0.14 | 0.78 | 0.50 | 1.32 | 2.00 | 0.85 |
| 029:2 | 0.58 | 0.24 | 0.34 | 0.54 | 1.01 | 0.56 | 0.41 | 5.70 | 1.39 | 1.10 |
| 029:1 | 0.15 | 0.10 | 0.13 | 0.24 | 0.80 | 0.40 | 0.17 | 0.82 | | 0.44 |
| 030:2 | | | | 0.03 | | 0.40 | | | | |
| 030:1 | | | | 0.06 | | 0.14 | | | | |
| 031:3 | 0.04 | | 0.02 | 0.16 | 0.04 | 0.27 | 0.11 | | | 0.15 |
| 031:2 | 0.03 | | 0.01 | 0.14 | 0.05 | 0.12 | 0.08 | 0.34 | 2.00 | 0.20 |
| 033:3 | | | | | | | | | 1.39 | |

*culture performed using E. coli C41 (DE3) ΔfadE, instead of E. coli MG 1655 ΔfadE Bioconversion of fatty acids enhanced the total production of olefins in the majority of the experiments. For example, the total amount of olefin produced after feeding C13, C14, C14:1 and C16:1 fatty acids was increased more than twofold when compared to the amount of olefin produced in the control strain which was not fed (see Table 23).

TABLE 23

Bioconversion of Fatty Acids to Olefins

| Fatty Acid | $OD_{600}$ | Total Olefin (mg/L/OD) |
|---|---|---|
| None | 1.51 | 3.13 |
| C10 | 1.62 | 3.47 |
| C12 | 1.89 | 4.3 |
| C13 | 3.53 | 7.18 |
| C14 | 2.78 | 9.96 |
| C15 | 3.45 | 4.71 |
| C17 | 2.55 | 2.18 |
| C14:1 | 2.4 | 24.44 |
| C16:1 | 3.79 | 7.95 |
| C18:1 | 2.24 | 5.7 |

The results of the experiments reflected in this example demonstrate that the expression of OleA, OleB, OleC, OleD, and FadD in E. coli results in the production of olefins derived from exogenous and endogenous fatty acids. In addition, the results of the experiments reflected in this example demonstrate that expression of OleA, OleB, OleC, OleD, and FadD in bacteria fed fatty acids results in the bioconversion of fatty acids to olefins and a significant increase in the total olefin production. Moreover, this example demonstrates that bioconversion can be used to control the types of olefins produced by the host.

EXAMPLE 13

This example demonstrates that fatty acids can be converted to aliphatic ketones by bacteria expressing an acyl-CoA synthase gene in combination with the acyl-condensing enzyme OleA.

The acyl-CoA synthase gene converts free fatty acids to activated fatty acyl-CoAs, one of the substrates for the OleA acyl-CoA condensation reaction.

The following host strain was used to generate the data shown in this example: E. coli MG1655 ΔfadE, with a constitutively expressed fadD gene generated by replacing the native promoter with a T5 constitutive promoter (see Example 1), transformed with the pCL1920pTrcOleA plasmid for expression of OleA (see Example 1 for description of this plasmid). The host strain was cultured, induced with IPTG, and fed fatty acids of different chain length according to the procedures described in Example 12. The 1 mL whole cell culture method was used to extract the hydrocarbons. The products were analyzed using GC/MS as described in Example 1.

The hydrocarbons detected by GC/MS were saturated as well as mono- and di-unsaturated aliphatic ketones that ranged from $C_{19}$ to $C_{31}$ (see Table 24). The type of fatty acid added to the fermentations and the aliphatic ketones that were observed are shown in Table 18. Even numbered carbon-chain aliphatic ketones were produced after feeding non-native fatty acids such as C13, C15, and C17.

TABLE 24

| Aliphatic ketone produced (mg/L/OD) | Feeding of fatty acids of different chain length | | | | | | | | | |
|---|---|---|---|---|---|---|---|---|---|---|
| | None | C10 | C12 | C13 | C14 | C15 | C17 | C14:1 | C16:1 | C18:1 |
| 25:1 | | | 0.10 | 0.01 | | | | 0.02 | 0.05 | 0.04 |
| 25:0 | | | | | | | | | | |
| 26:1 | | | | 0.05 | | | | | | |
| 26:0 | | | | 0.02 | | | | | | |
| 27:2 | 0.06 | 0.39 | 0.72 | 0.19 | 0.26 | 0.97 | 1.46 | 0.85 | 0.85 | 0.53 |
| 27:1 | 0.07 | 0.43 | 0.70 | 0.25 | 0.50 | 1.07 | 1.41 | 3.77 | 1.87 | 1.17 |
| 27:0 | 0.01 | 0.05 | 0.11 | 0.04 | 0.14 | 0.14 | 0.21 | 2.58 | 0.42 | 0.36 |
| 28:1 | | | | 0.03 | | 0.19 | 0.02 | | | |
| 28:0 | | | | 0.02 | | 0.07 | 0.01 | | | |
| 29:2 | 0.02 | 0.19 | 0.37 | 0.09 | 0.14 | 0.52 | 0.71 | 0.33 | 0.80 | 0.16 |
| 29:1 | 0.02 | 0.13 | 0.27 | 0.08 | 0.21 | 0.60 | 0.70 | 1.37 | 1.41 | 0.16 |
| 29:0 | | | | | 0.04 | 0.06 | 0.07 | 0.99 | 0.17 | |
| 31:2 | | | | | | 0.03 | | | 0.12 | |
| 31:1 | | | | | | | | | 0.14 | |

Bioconversion of fatty acids enhanced the production of aliphatic ketones in all of the samples tested with a greater than 50 fold enhancement when feeding a preferred substrate such as C14:1 (see Table 25).

TABLE 25

Bioconversion of Fatty Acids to Aliphatic Ketones

| Fatty Acid | $OD_{600}$ | Total Aliphatic Ketones (mg/L/OD) |
|---|---|---|
| None | 3.53 | 0.19 |
| C10 | 3.43 | 1.20 |
| C12 | 4.26 | 2.28 |
| C13 | 4.29 | 0.78 |
| C14 | 5.48 | 1.29 |
| C15 | 4.09 | 3.65 |
| C17 | 4.04 | 4.59 |
| C14:1 | 4.63 | 9.91 |
| C16:1 | 4.15 | 5.83 |
| C18:1 | 4.18 | 2.42 |

The results of the experiments reflected in this example demonstrate that the expression of OleA and FadD in E. coli resulted in the production of aliphatic ketones derived from exogenous and endogenous fatty acids. In addition, the results of the experiments reflected in this example demonstrate that the expression of OleA and FadD in bacteria fed fatty acids resulted in the bioconversion of fatty acids to aliphatic ketones and a significant increase in total aliphatic ketone production. This example demonstrates that bioconversion can be used to control the types of aliphatic ketones produced by the host strain as well as to enhance the amounts of aliphatic ketones produced.

EXAMPLE 14

This example demonstrates ways to control the types of olefins that can be produced in bacteria.

In order to produce acyl-CoAs (a substrate for aliphatic ketone and olefin synthesis) of differing chain length in bacteria, different thioesterases, including Uc FatB1 (Voelker et al., Science, 257: 72-74 (1992)), Ch FatB2 (Dehesh et al., Plant J., 9: 167-72 (1996)), 'TesA (Cho et al., supra), or Cc FatB1 (Yuan et al., Proc. Natl. Acad. Sci. USA, 92: 10639-43 (1995)) were produced in combination with a acyl-CoA synthase (FadD; EC 6.2.1.3). In order to produce olefins with different chain lengths, variations in the type of acyl-CoA substrates produced (i.e., bacteria expressing different thioesterases) were combined with olefin synthase genes oleA, oleB, oleC, and oleD.

A number of strains were generated that demonstrate the ability to produce a range of olefins with varying chain lengths (see Table 26). All strains were made in the E. coli C41(DE3) ΔfadE host using standard methods of transformation, such as electroporation or chemical transformation. To maintain each plasmid within the strain, the appropriate antibiotic selection was applied throughout the experiment. A control strain (OS333), which does not contain the thioesterase plasmid, was generated. In addition, strains expressing the combination of a thioesterase, a fatty acyl-CoA synthase, and the olefin synthase genes were generated. A detailed description of the construction of each plasmid can be found in Example 1. A list of the strains used in this example is shown in Table 26.

The length of the olefin and the degree of unsaturation are indicated as CX:Y, wherein X represents the number of carbons in the olefin and Y indicates the number of double bonds.

The results reflected in Table 27 demonstrate that expression of a thioesterase in combination with a fatty acyl-CoA

TABLE 26

| Strain # | Olefin Synthase | Acyl-CoA synthase | Thioesterase |
|---|---|---|---|
| OS333 | pCL1920pTrcOleABpTrcLOleCD | pACYCDuet-fadD | None |
| OS335 | pCL1920pTrcOleABpTrcLOleCD | pACYCDuet-fadD | pLS9-80 (Uc FatB1) |
| OS336 | pCL1920pTrcOleABpTrcLOleCD | pACYCDuet-fadD | pLS9-82 (Ch FatB2) |
| OS338 | pCL1920pTrcOleABpTrcLOleCD | pACYCDuet-fadD | pLS9-85 ('TesA) |
| OS342 | pCL1920pTrcOleABpTrcLOleCD | pACYCDuet-fadD | pLS9-77 (Cc FatB1) |

Standard 25 mL fermentations and standard 1 mL whole cell culture extractions were performed as described in Example 1. Samples were analyzed by the GC/MS method described in Example 1. An internal standard of hexacosane was used to determine the amounts of each olefin produced (see Table 27).

In 1962 Marr and Ingraham published a paper demonstrating that temperature influences the degree of saturation in lipids produced by *E. coli* (Man et al., *J Bacteriol.*, 84: 1260-7 (1962)). Low temperatures result in the production of lipids with a greater degree of unsaturation while higher temperatures result in higher quantities of saturated lipids. To determine if temperature influences the degree of saturation, the fermentations were performed at two different temperatures, 37° C. and 25° C. The top of Table 27 shows the results for fermentations performed at 37° C., and the bottom half of Table 27 shows the results for fermentations performed at 25° C.

synthase and olefin synthase genes produces olefins with different chain lengths depending on the thioesterase used. Thioesterases such as Uc FatB1, which is known as a lauroyl-acyl carrier protein thioesterase with specificity for C12:0 fatty acyl-ACPs, and Ch FatB2 can be used to produce C23 and C25 length olefins, which are not seen in the control strain. These results also demonstrate that the amount of a specific olefin, such as a C27 olefin, can be enhanced by the addition of a thioesterase with specificity for C14 fatty acyl-ACPs, such as Cc FatB1. Alternatively, the amount of C27 and C29 can be enhanced by the addition of 'TesA, which has specificity for C14 and C16 chain length fatty acyl-ACPs.

The results set forth in Table 27 also demonstrate that the temperature at which the fermentation is performed will influence the types of olefins that are produced by the bacteria. In particular, temperature influences the saturation level of the olefins produced. Olefins with a single double bond are formed from the condensation of two saturated fatty acids.

TABLE 27

| Olefin ((mg/L)/OD600 unit) | | | | | | | | |
|---|---|---|---|---|---|---|---|---|
| | C23:2 | C23:1 | C25:2 | C25:1 | C27:3 | C27:2 | C27:1 | C29:3 |
| 37° C. | | | | | | | | |
| no TE | | | | | 0.354 | 0.253 | 0.037 | 0.314 |
| UcFatB1 | | 0.150 | 0.591 | 0.106 | 0.633 | 0.488 | 0.114 | 0.459 |
| ChFatB2 | | | | | 0.936 | 0.729 | 0.095 | 0.793 |
| tesA | | | | | 0.767 | 0.650 | 0.104 | 0.708 |
| CcFatB1 | | | | | 0.668 | 0.654 | 0.130 | 0.453 |
| 25° C. | | | | | | | | |
| no TE | | | | | 0.787 | 0.378 | | 1.737 |
| UcFatB1 | | | 0.981 | | 1.955 | 0.298 | | 1.640 |
| ChFatB2 | 0.225 | | 0.236 | | 0.364 | 0.191 | | 0.821 |
| tesA | | | 0.069 | | 1.175 | 1.201 | 0.263 | 2.599 |
| CcFatB1 | | | 0.335 | 0.118 | 2.168 | 2.384 | 0.533 | 2.300 |

| | C29:2 | C29:1 | C31:3 | C31:2 | C33:1 | Total | OD600 units |
|---|---|---|---|---|---|---|---|
| 37° C. | | | | | | | |
| no TE | 0.423 | 0.050 | 0.168 | 0.012 | | 1.611 | 3.105 |
| UcFatB1 | 0..383 | 0.014 | 0.168 | | | 3.106 | 1.342 |
| ChFatB2 | 1.093 | 0.136 | 0.273 | | | 4.055 | 1.754 |
| tesA | 0..583 | 0.091 | 0.173 | 0.076 | | 3.153 | 3.136 |
| CcFatB1 | 0.644 | 0.106 | 0.222 | 0.042 | | 2.919 | 3.567 |
| 25° C. | | | | | | | |
| no TE | 0.863 | | 1.621 | 0.305 | 0.300 | 5.991 | 1.542 |
| UcFatB1 | 0.403 | | 0.466 | | | 5.742 | 0.402 |
| ChFatB2 | 0.381 | | 0.675 | 0.129 | 0.135 | 2.933 | 2.030 |
| tesA | 1.589 | 0.173 | 1.255 | | 0.094 | 8.417 | 2.192 |
| CcFatB1 | 1.424 | 0.179 | 1.818 | 0.684 | 0.191 | 12.135 | 3.168 |

Fermentations performed at 37° C. result in the production of olefins with a higher degree of saturation compared to fermentations that were performed at 25° C.

The results of the experiments reflected in this example demonstrate that by combining olefin synthase genes with genes that produce different chain length fatty acyl-CoAs, the length of the olefin produced can be controlled. In addition, the results of the experiments reflected in this example demonstrate that the degree of saturation in the olefins produced by the bacteria can be controlled by altering environmental conditions, such as the temperature of the fermentations.

EXAMPLE 15

This example demonstrates the functional expression of oleA in *Saccharomyces cerevisiae* results in the in vitro production of aliphatic ketones.

The oleA nucleic acid sequence was PCR amplified by standard methods from a plasmid containing the *Stenotrophomonas maltophilia* ATCC 17679 oleA gene sequence (SEQ ID NO: 1) and cloned into yeast expression vectors using standard techniques, as described herein. Briefly, oleA (SEQ ID NO: 1) was amplified using primers LB217 (SEQ ID NO: 43) and LF304 (SEQ ID NO: 44). The oleA amplification product was cloned into pESC-HIS using the restriction enzymes ApaI and XhoI creating plasmid pESC-His-oleA (SEQ ID NO: 134).

*S. cerevisiae* (BY4741) yeast cells were then transformed with either a plasmid containing oleA (SEQ ID NO: 134) or a plasmid not containing oleA. The transformed yeast cells were cultured to allow expression of oleA. The cells were pelleted and then lysed using YeastBuster™ (Novagen, Madison, Wis.). Myristoyl-CoA was added to the cell lysate. The aliphatic ketones were extracted from the reaction using 1% acetic acid in ethyl acetate and analyzed using GC/MS, as described in Example 1.

Figure 14:
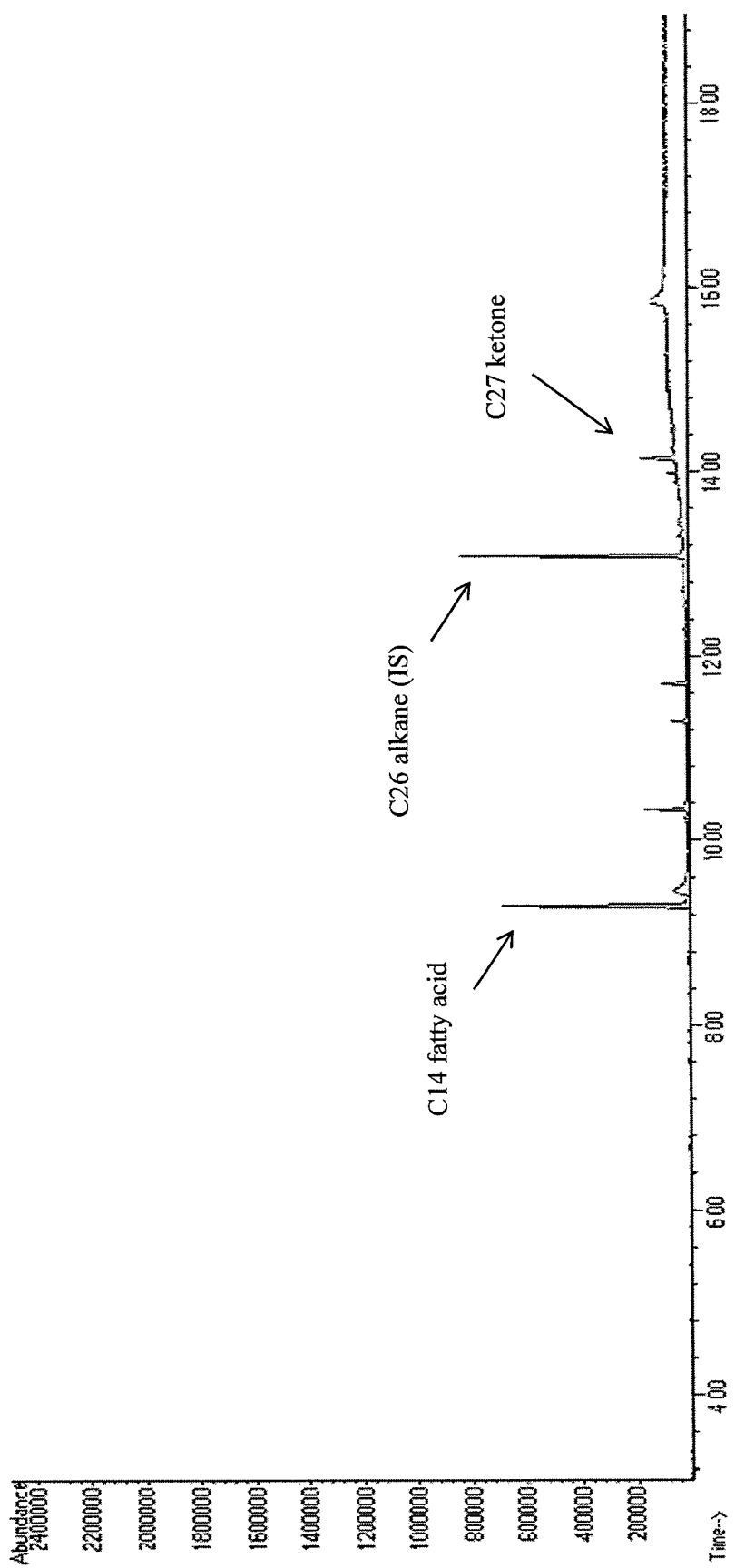
Figure 15A:
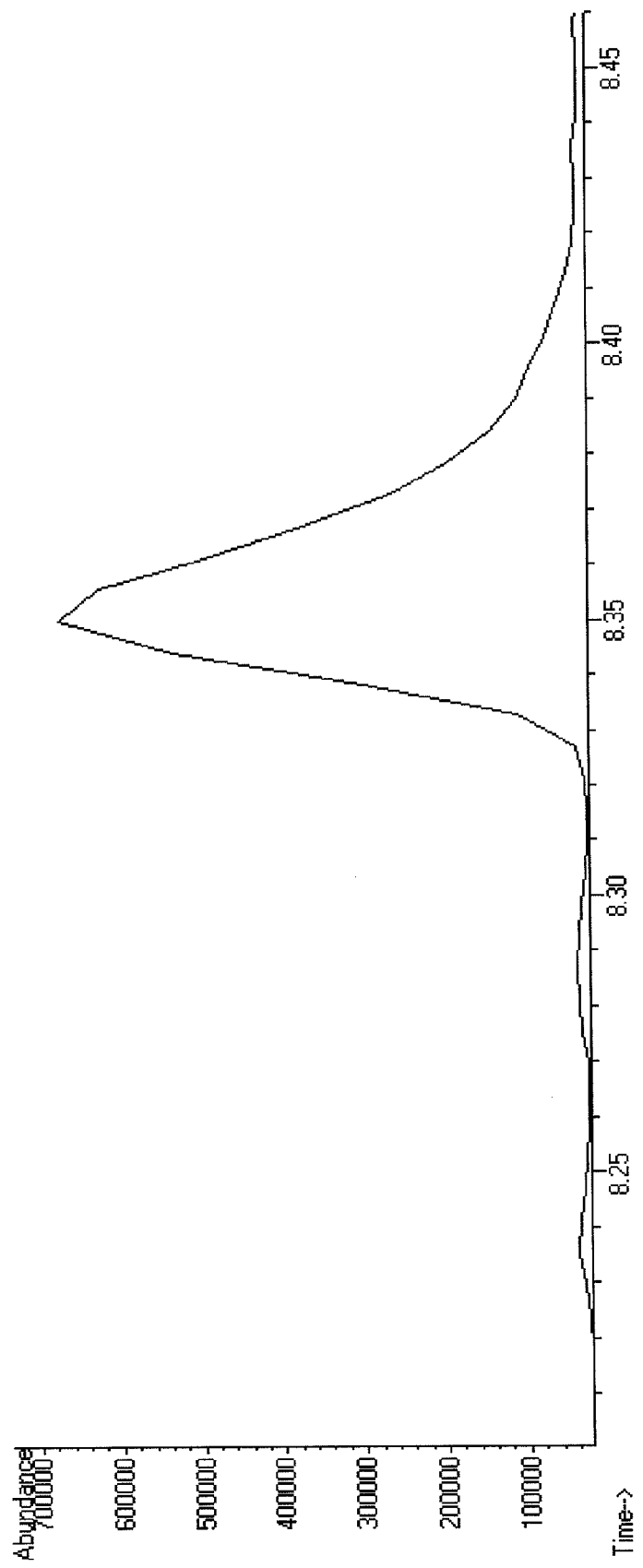
Figure 15B:
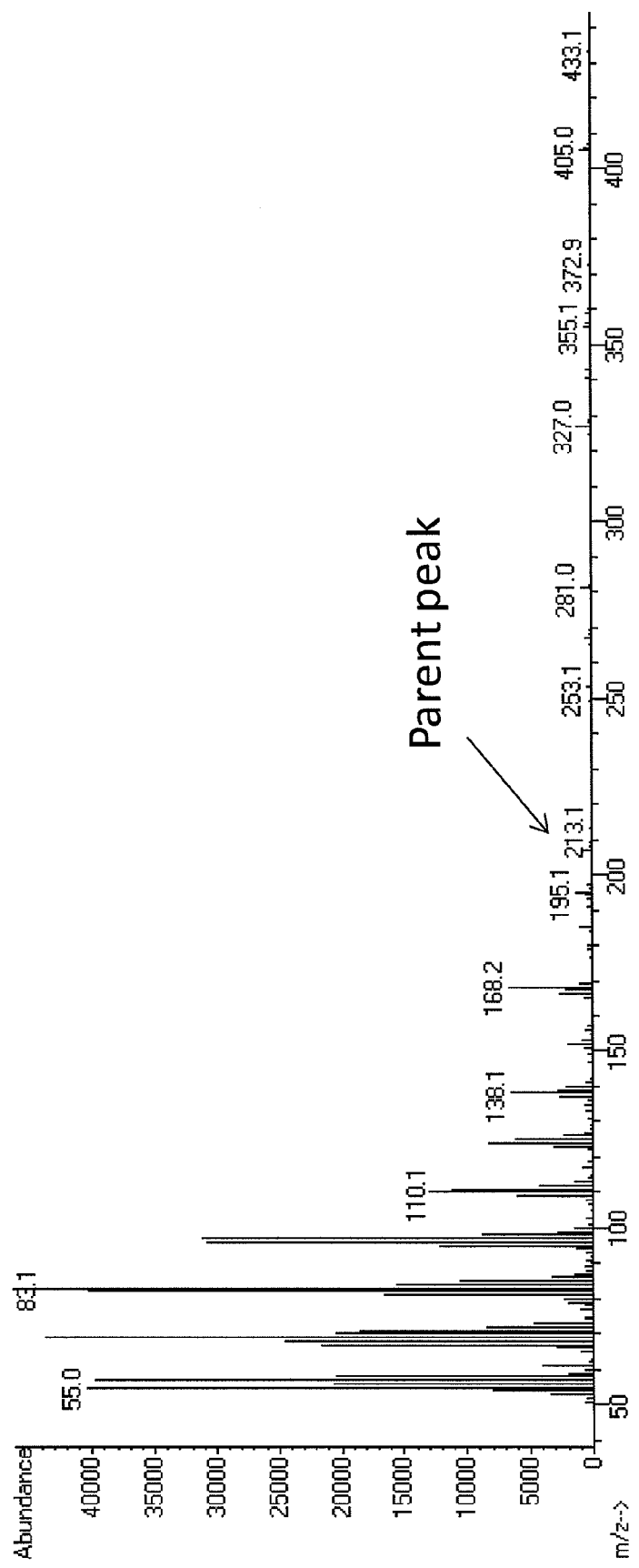
Figure 15C:
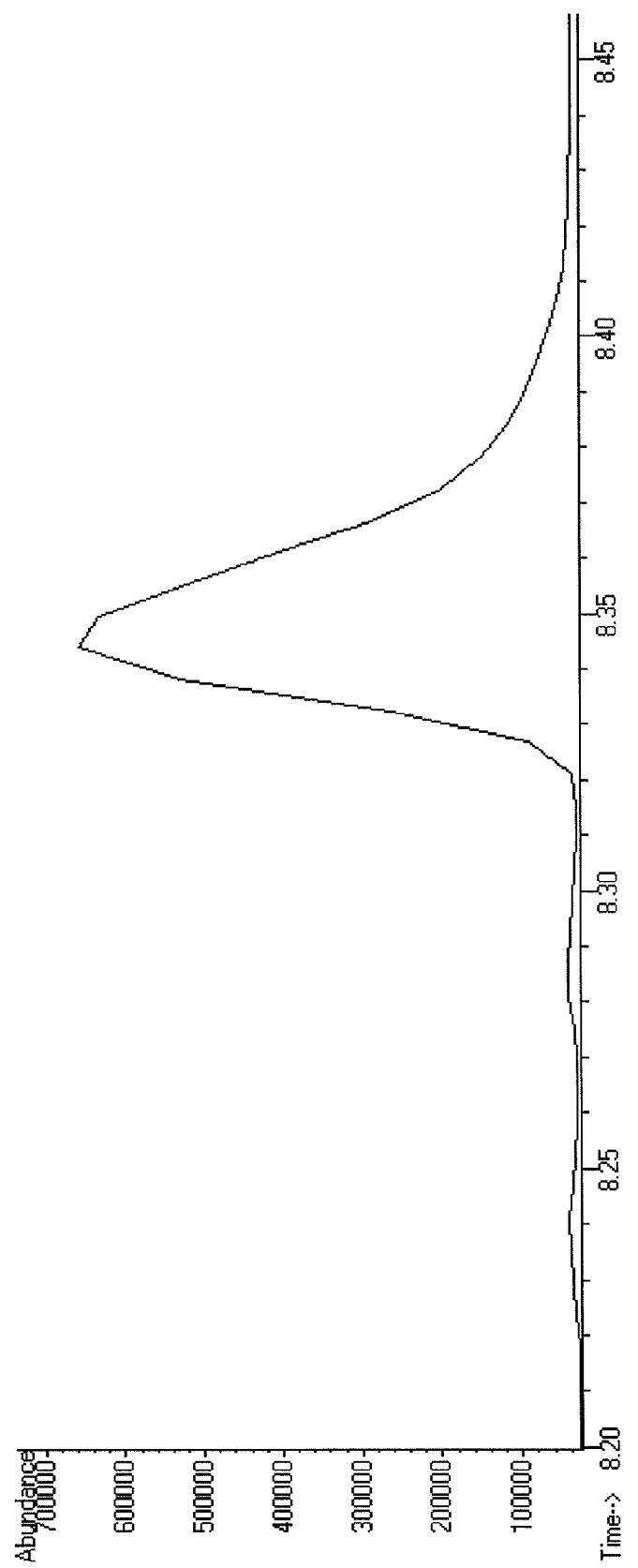
Figure 15D:
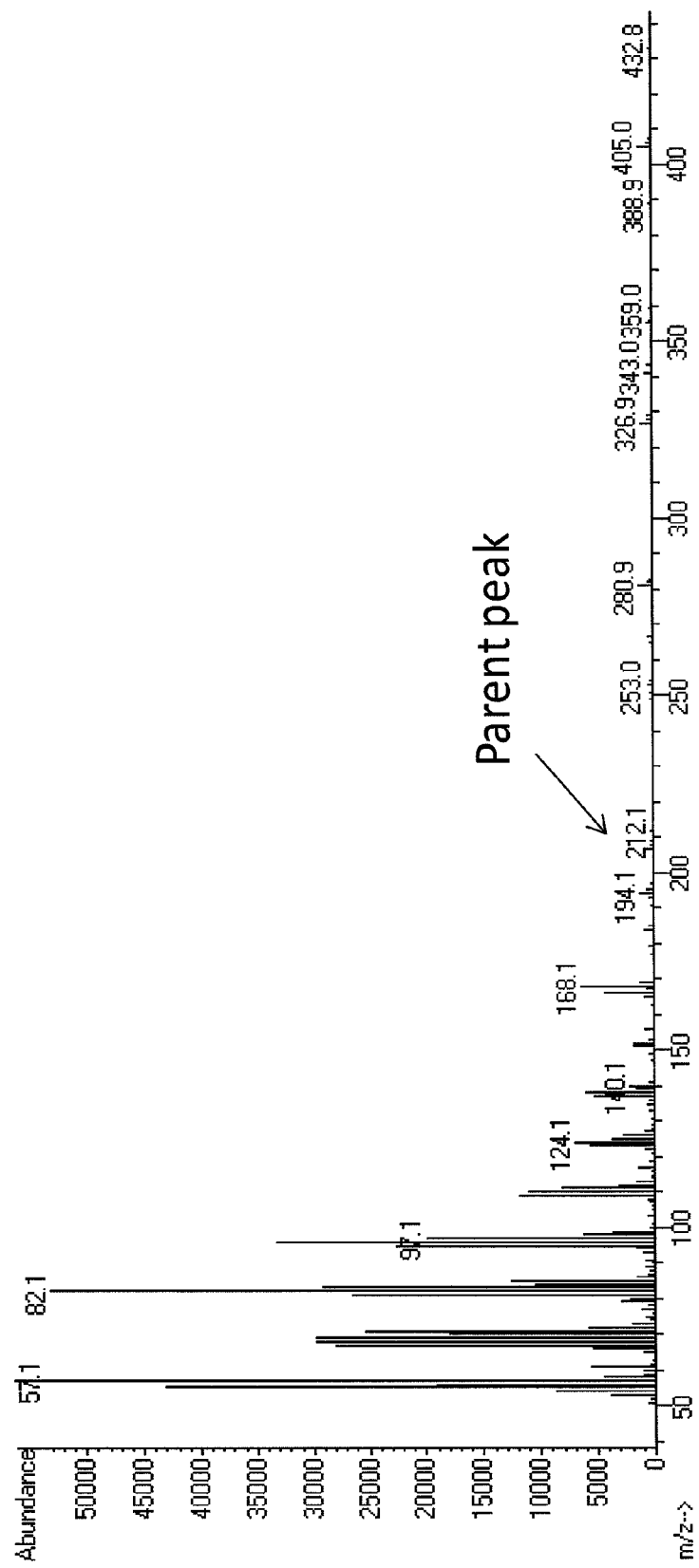
Figure 15E:
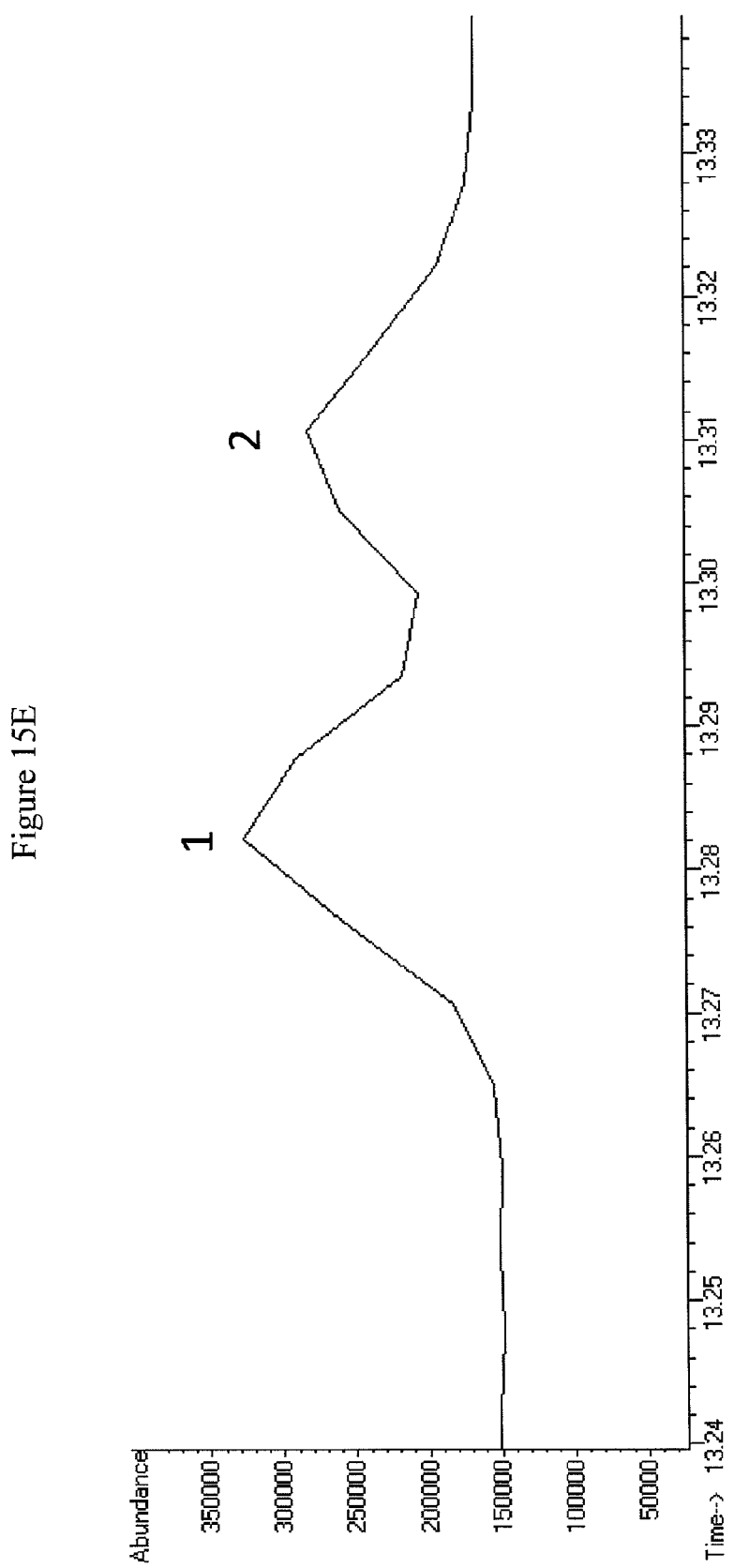
Figure 15F:
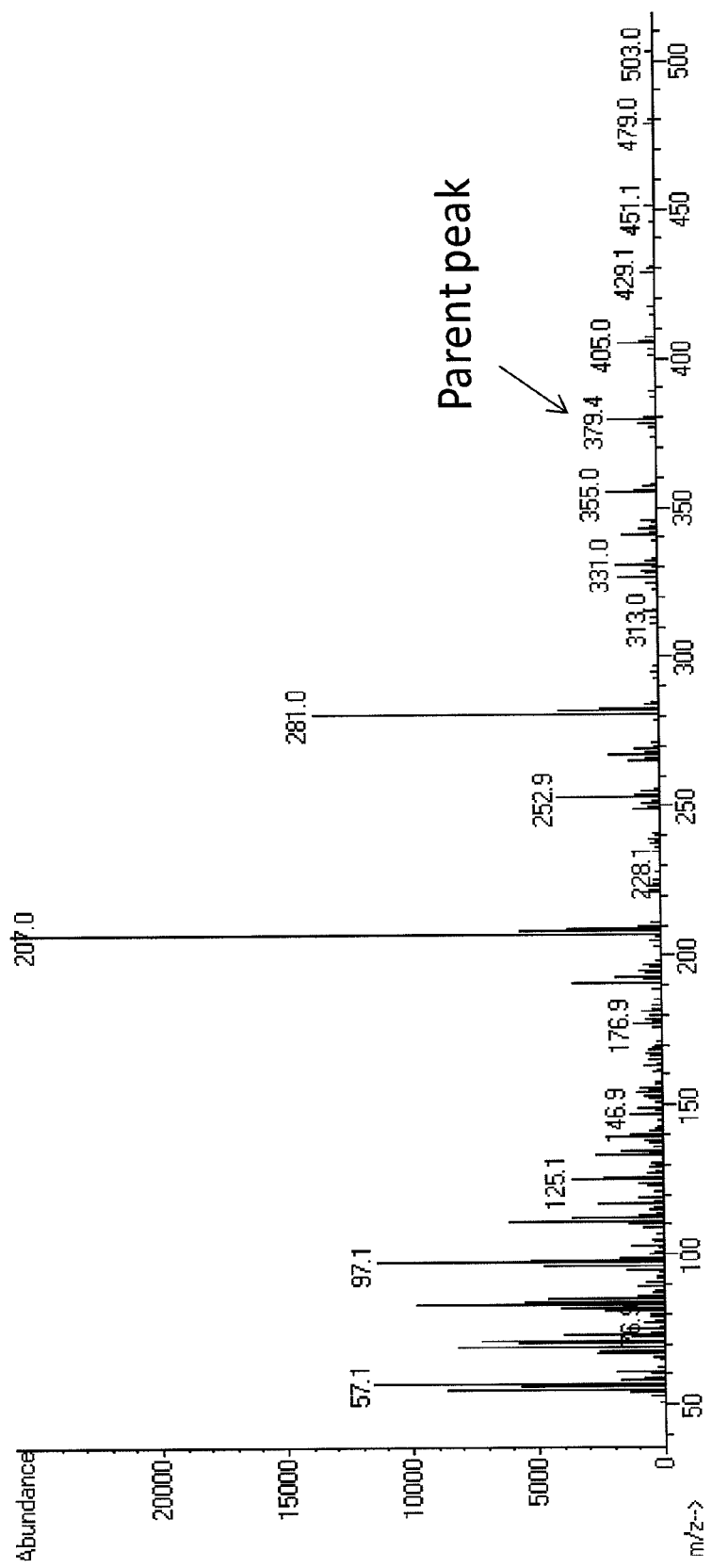
Figure 15G:
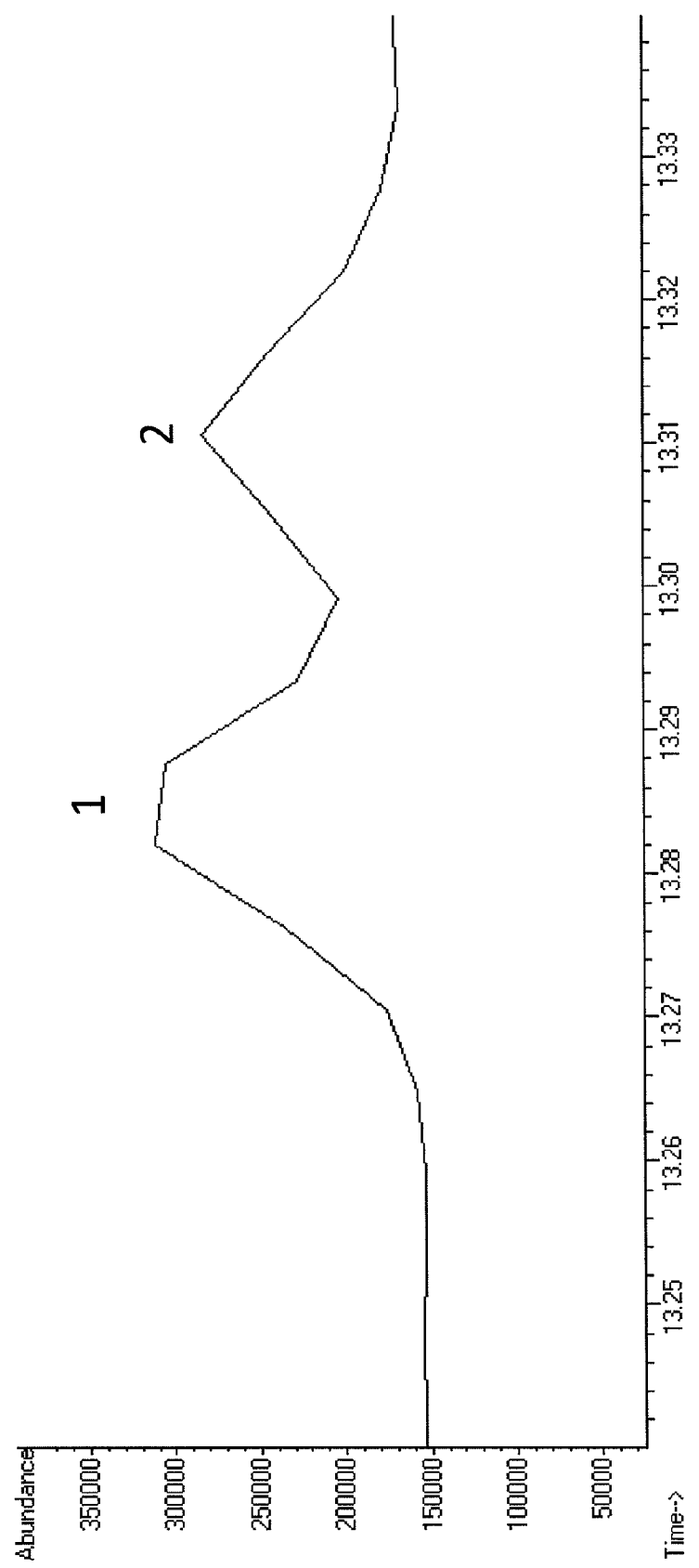
Figure 15H:
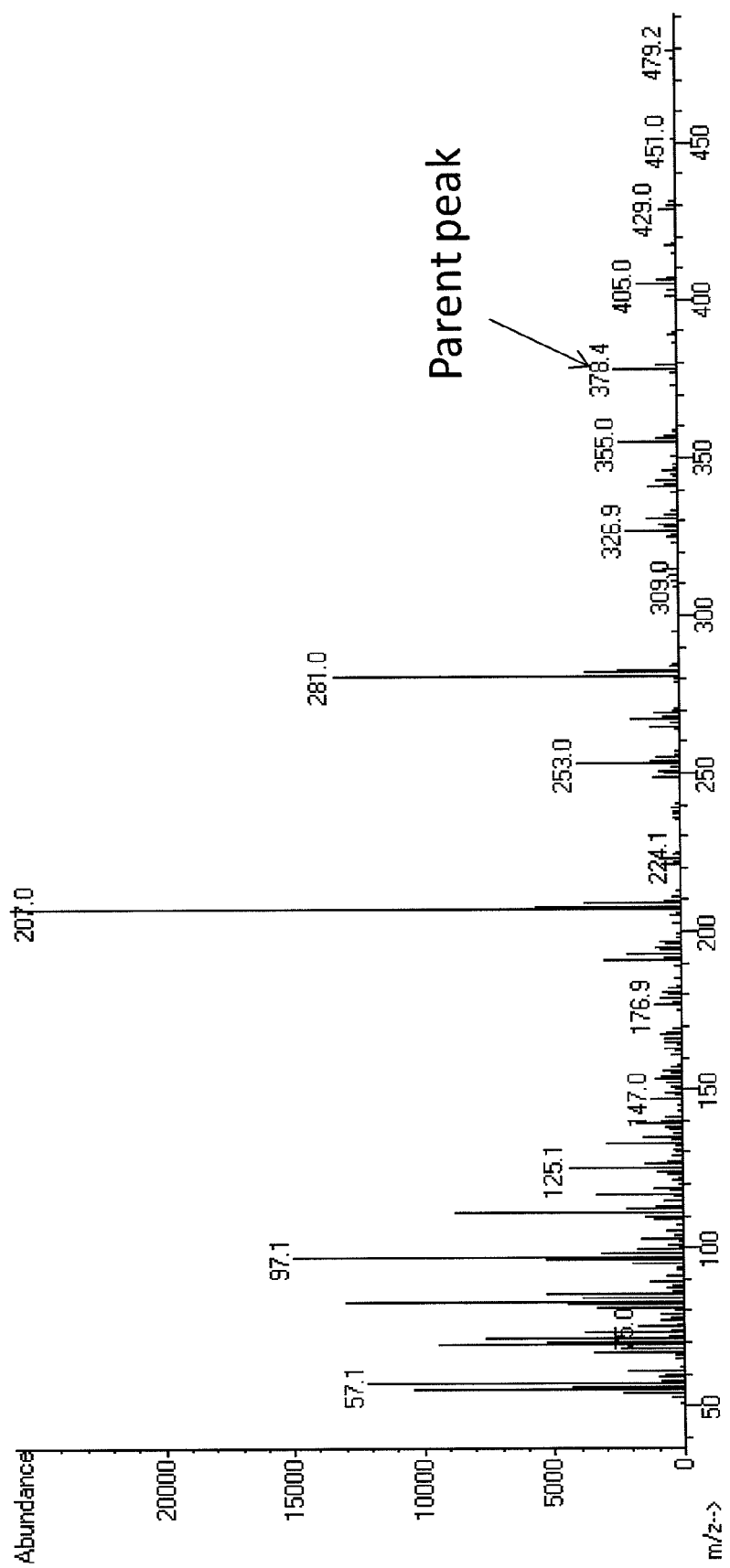

The aliphatic ketone 14-heptacosanone, a C27 aliphatic ketone, was identified by GC/MS in cell lysates from yeast cells transformed with the oleAplasmid pESC-His-oleA (see FIG. 14A). This demonstrates that oleA can be expressed in *S. cerevisiae* to produce aliphatic ketones. Similar methods can be used to express oleA in any cell of interest, prepare cell lysate, and subsequently analyze the production of aliphatic ketones.

The results of the experiment reflected in this example demonstrate that oleA can be expressed in *S. cerevisiae* leading to the in vitro production of aliphatic ketones.

EXAMPLE 16

This example demonstrates that deuterated aldehydes and olefins are observed in an in vitro assay containing purified OleA, cell lysate containing OleD, and deuterated NADPH.

OleA protein was produced for these experiments by fermentation of *E. coli* C41(DE3) transformed with pET-21b(+)_OleA. The His-tagged OleA was purified as described in Example 10. OleD cell lysate was produced for these experiments by fermentation of *E. coli* C41(DE3) transformed with pET-21b(+)_OleD using overnight express instant TB medium according to the manufacturer's protocol (Novagen, CA). 10 mL of overnight culture was used to prepare the cell lysates. The culture was centrifuged to concentrate the cells into a pellet. The supernatant was removed. The pellet was resuspended in 2 mL of 50 mM sodium phosphate buffer (pH 7.0). The cell suspension was then lysed using sonication (5 times in 5 sec pulses at 0.5 power). 2 µL of Benzonase® (Novagen, CA) was added to the cell lysate and the sample was kept at room temperature for 20 minutes. This cell lysate was used as the source of OleD protein.

Deutero-NADPH was prepared according to the following protocol. 5 mg of $NADP^+$ and 3.6 mg of D-glucose-1-d was added to 2.5 mL of 50 mM sodium phosphate buffer (pH 7.0). Enzymatic production of labeled NADPH was initiated by the addition of 5 units of glucose dehydrogenase from either *Bacillus megaterium* (USB Corporation) for the production of R-(4-$^2$H)NADPH or *Thermoplasma acidophilum* (Sigma) for the production of S-(4-$^2$H)NADPH. The reaction was incubated for 15 minutes at 37° C., centrifuge-filtered using a 10 KDa MWCO Amicon Ultra centrifuge filter (Millipore), flash frozen on dry ice, and stored at −80° C.

The in vitro assay reaction contained 0.1 mM myristoyl coenzyme A, 10 mM $MgCl_2$, 10 µL of 1/10 dilution of OleD lysate, 50 µL deutero-NADPH (prepared as described above), 2.1 µM OleA, and 100 mM phosphate buffer (pH 7.0) in a total volume of 0.1 mL. The myristoyl coenzyme A used was obtained from Sigma (M4414, St Louis Mo.) and prepared as a 10 mM stock solution in 0.1 M phosphate buffer pH 7.0. Samples were incubated at 37° C. for 1 hour. The reaction was quenched with 500 µL of ethyl acetate containing 1% acetic acid/0.15% formic acid. The mixture was mixed by vortexing followed by centrifugation. The top layer (ethyl acetate layer) was transferred to a clean glass tube and dried under vacuum in a centrifuge (Vacufuge 5301, Eppendorf, Westbury, N.Y.). The sample was resuspended in 40 µL of ethyl acetate and 10 µL of 0.1 mg/mL solution of hexacosane (prepared in ethyl acetate), which acted as a control spike, and analyzed by GC/MS. Between 1 and 10 µL were analyzed for specific hydrocarbons.

The resulting aldehydes and olefins detected by GC/MS were tetradecanal and isomers of heptacosene (see FIG. 15A-H). Because hydride transfer from NADPH is stereospecific, both R-(4-$^2$H)NADPH and S-(4-$^2$H)NADPH were synthesized. Aldehyde and olefins with a plus one unit mass were observed using only the R-(4-$^2$H)NADPH. The fact that the aldehyde and olefins were labeled indicates that the deuterated hydrogen has been transferred from the labeled NADPH to the labeled aldehyde or olefin. This demonstrates that NADPH is used in the enzymatic reaction. The fact that the hydride transfer is stereospecific is indicative of an enzymatic reaction.

The results of the experiment reflected in this example demonstrate that oleD encodes a pyridine nucleotide oxidoreductase. Furthermore, these results demonstrate that OleD catalyzes the hydride transfer from NADPH to intermediates in olefin biosynthesis, such that that transferred hydride remains in the olefin product. Hydride transfer occurring in the presence of OleA and myristoyl CoA resulted in the detection of both C1-deutero-tetradecanal, and C14-deutero, delta-13, heptacosene.

EXAMPLE 17

This example demonstrates the ability to synthesize aliphatic olefins in vitro.

Protocol for Protein Expression and Preparation of Lysate for Assessing Activity of OleA/B/C/D Proteins

*E. coli* C41(DE3) transformed with pETDuet_OleAB and pCOLADuet_OleCD was used to create a bacterial lysate containing the four Ole proteins (OleA, OleB, OleC and OleD).

*E. coli* C41(DE3) cells transformed with pETDuet_OleAB and pCOLADuet_OleCD were grown in Luria Broth containing kanamycin (50 µg/mL final concentration) and carbenecillin (100 µg/mL final concentration) to $OD_{600}$ of 0.5-

1.0 at 37° C. The cultures were then induced with 1 mM IPTG and grown overnight at 37° C. The overnight grown cultures were centrifuged at 3000 rpm for 20 minutes. The supernatant was discarded. The pellets were frozen at −80° C. to be used later. Cell pellets obtained from 10 mL of induced overnight cultures were resuspended in 2 mL of buffer and lysed using sonication (5 times in 5 sec pulses at 0.5 power). In the sonicated lysate, 2 µL of Benzonase® (Novagen, CA) was added, and the sample was kept at room temperature for 20 minutes. This lysate was used as the source of OleA, OleB, OleC, and OleD proteins.

Protocol for Preparation of myristoyl-ACP

Myristoyl-ACP was synthesized as described in Rock et al., *Methods Enzymol.*, 72: 397-403 (1981), with some modifications. Briefly, a reaction mixture containing 5 mM ATP, 2 mM DTT, 2% Triton X-100, 10 mM LiCl, 160 µM Myristic acid-sodium salt, 65 µM ACP-SH, 10 mM $MgCl_2$, 0.1 M Tris-HCl pH 8.0, and 1.5-3 µg/mL acyl-ACP synthase in a final volume of 1-4 mL was incubated at 37° C. for 3 hours and then incubated overnight at 30° C. The acyl-ACP synthase used was purchased from Invitrogen. The reaction mixture was diluted with three volumes of water and the pH was titrated to 6.0 with acetic acid. The solution was applied to a HiTrap DEAE FF 5 mL column (GE Healthcare). The column was washed with three column volumes of 10 mM bis-Tris-HCl, pH 6.0, to remove the bulk of the Triton X-100. The residual Triton X-100 and the free fatty acid was removed by eluting the column with three column volumes of 80% 2-propanol. The 2-propanol was cleared with three column volumes of 10 mM bis-Tris-HCl, pH 6.0. The myristoyl-ACP and the unreacted ACP-SH were eluted from the column with 10 mL of 0.6 M LiCl in 10 mM bis-Tris-HCl, pH 6.0. The eluate containing myristoyl-ACP was buffer exchanged into 50 mM sodium-phosphate buffer pH 7.0 and concentrated to 1 mL using MWCO 3 kDa concentrators (Millipore). The myristoyl-ACP concentration was determined using the Bradford assay (BioRad) and densitometry analysis on NuPAGE 12% Bis-Tris SDS-PAGE gel (Invitrogen) in two steps: first, the total protein concentration of the C14-ACP/ACP-SH fraction was determined by a Bradford assay (Bio-Rad protein assay); second, the C14-ACP concentration was calculated as a percent of the total protein concentration based on SDS-PAGE followed by a densitometry analysis. C14-ACP was stored in 50 mM Na-phosphate buffer, pH 7.0 at −20° C. and was stable for up to 3 months.

A Method to Produce Olefins

*E. coli* C41(DE3) transformed with pETDuetOleAOleB and pCOLADuetOleCOleD was used to create a cell lysate containing OleA, OleB, OleC, and OleD proteins as described above. The in vitro assay reaction contained 0.1 mM myristoyl coenzyme A or 0.1 mM myristoyl-ACP, 10 mM $MgCl_2$, 360 µL of cell Lysate from *E. coli* C41(DE3) transformed with pETDuetOleAOleB and pCOLADuetOle-COleD, 1 mM NADPH (Sigma, Mo.), 1 mM ATP (Sigma, Mo.), 1 mM HSCoA (Sigma, Mo.), and 100 mM phosphate buffer (pH 7.0) in a total volume of 1 mL. The myristoyl coenzyme A used was obtained from Sigma (M4414, St Louis Mo.) and prepared as a 10 mM stock solution in 0.1 M phosphate buffer pH 7.0. Samples were incubated at 37° C. for 1 hour. The reaction was quenched with 5 mL of ethyl acetate containing 1% acetic acid/0.1% formic acid. The mixture was mixed by vortexing followed by centrifugation. 4 mL of the top layer (ethyl acetate layer) was transferred to a clean glass tube and dried under vacuum in a centrifuge (Vacufuge 5301, Eppendorf, Westbury, N.Y.). The sample was resuspended in 40 µL of ethyl acetate and 10 µL of 0.1 mg/mL solution of hexacosane (prepared in ethyl acetate), which acted as a control spike, and analyzed by GC/MS. 1 µL was analyzed for specific hydrocarbons.

Figure 16A:
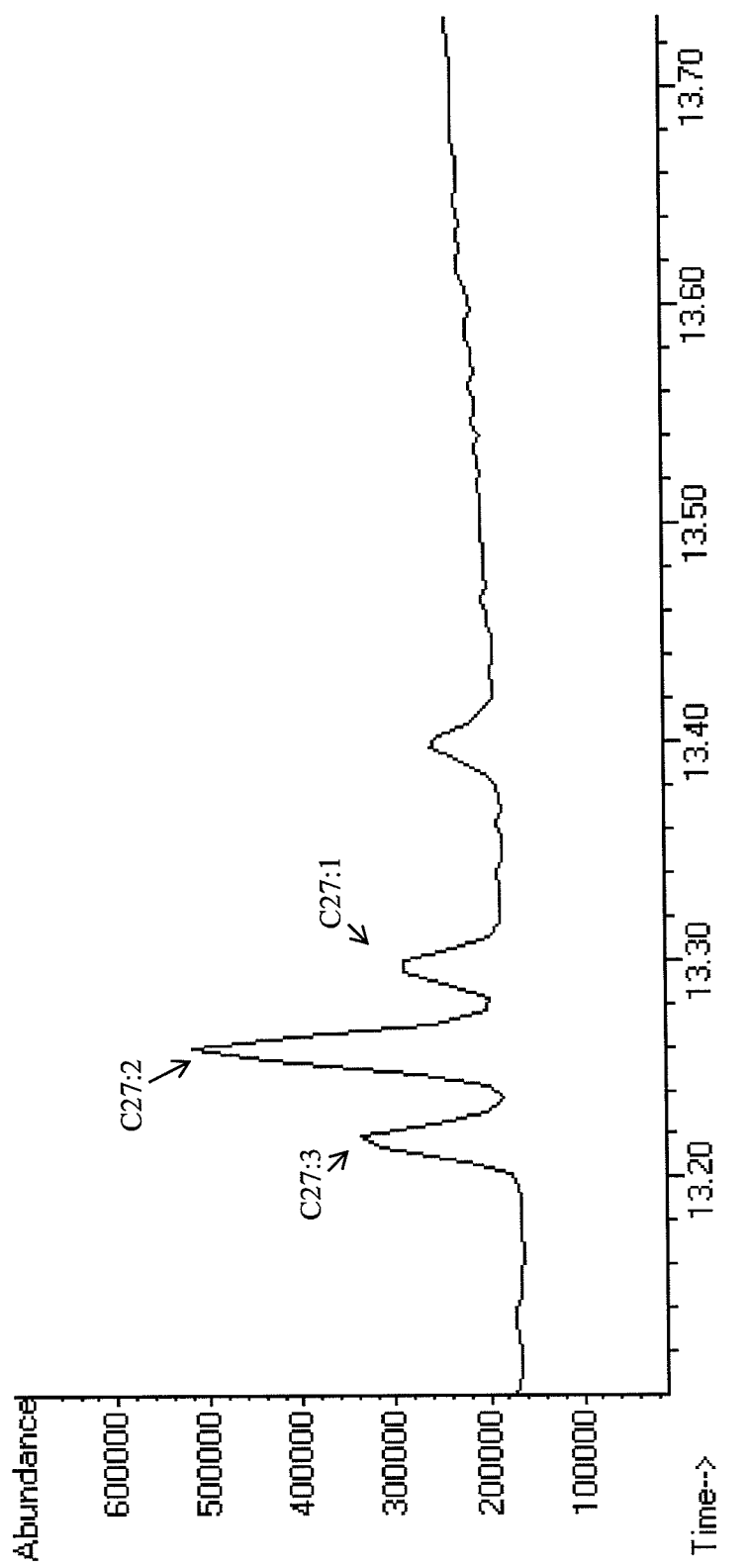
Figure 16B:
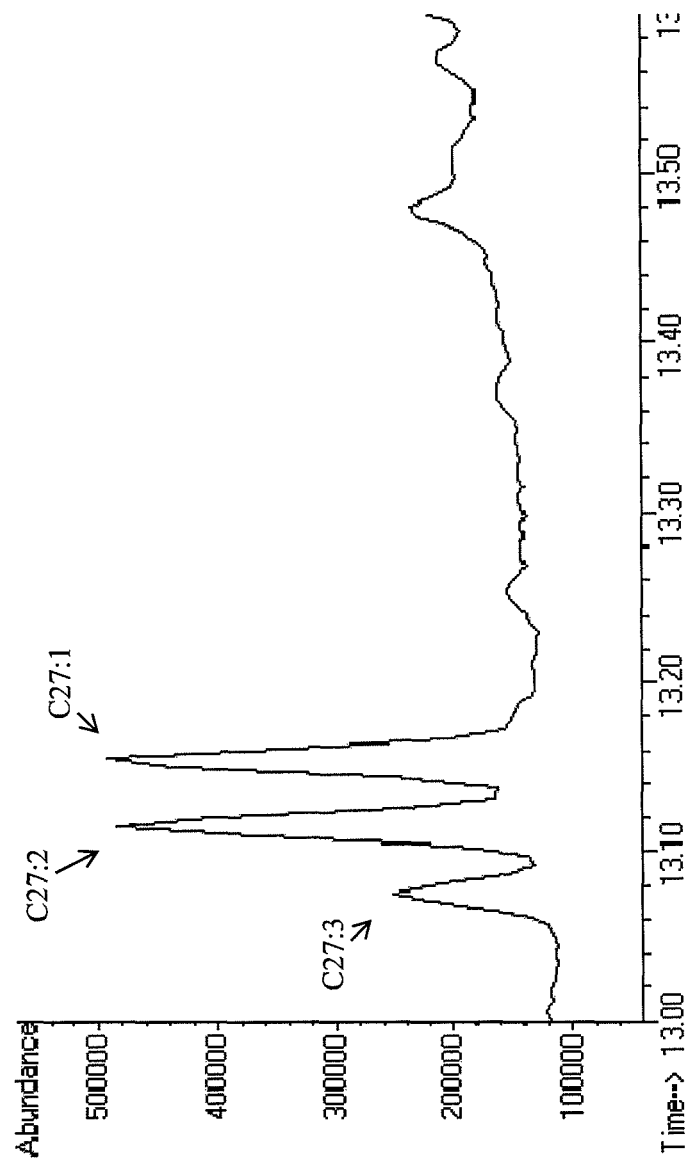
Figure 16C:
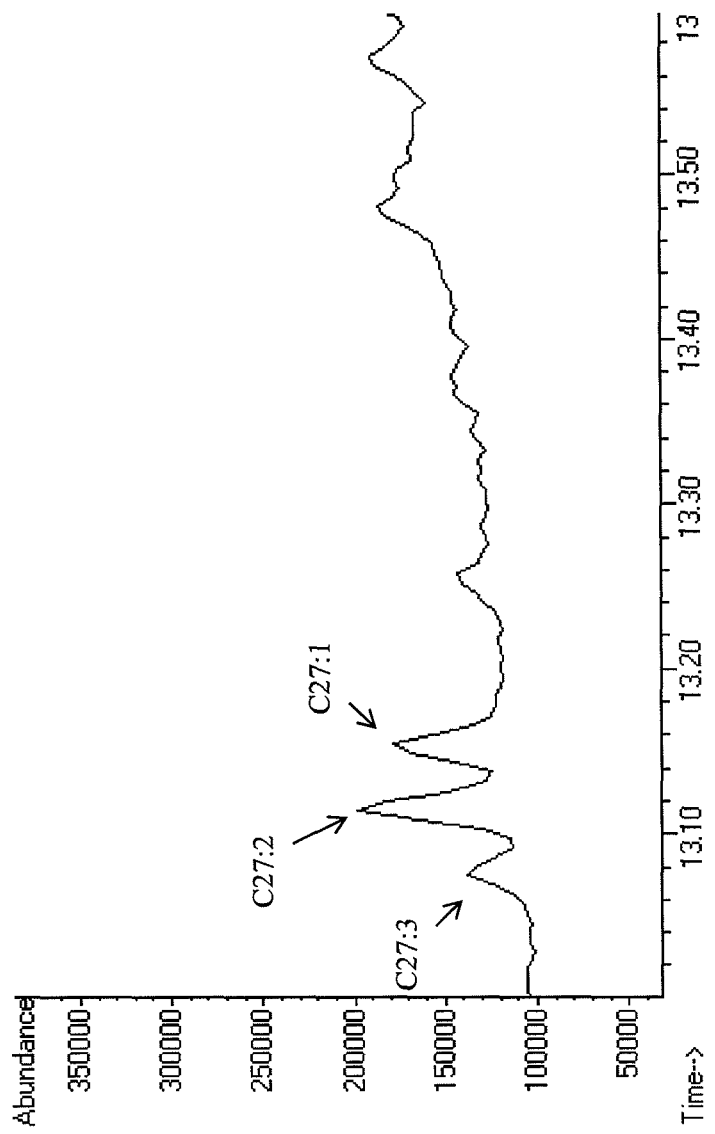
Figure 17B:
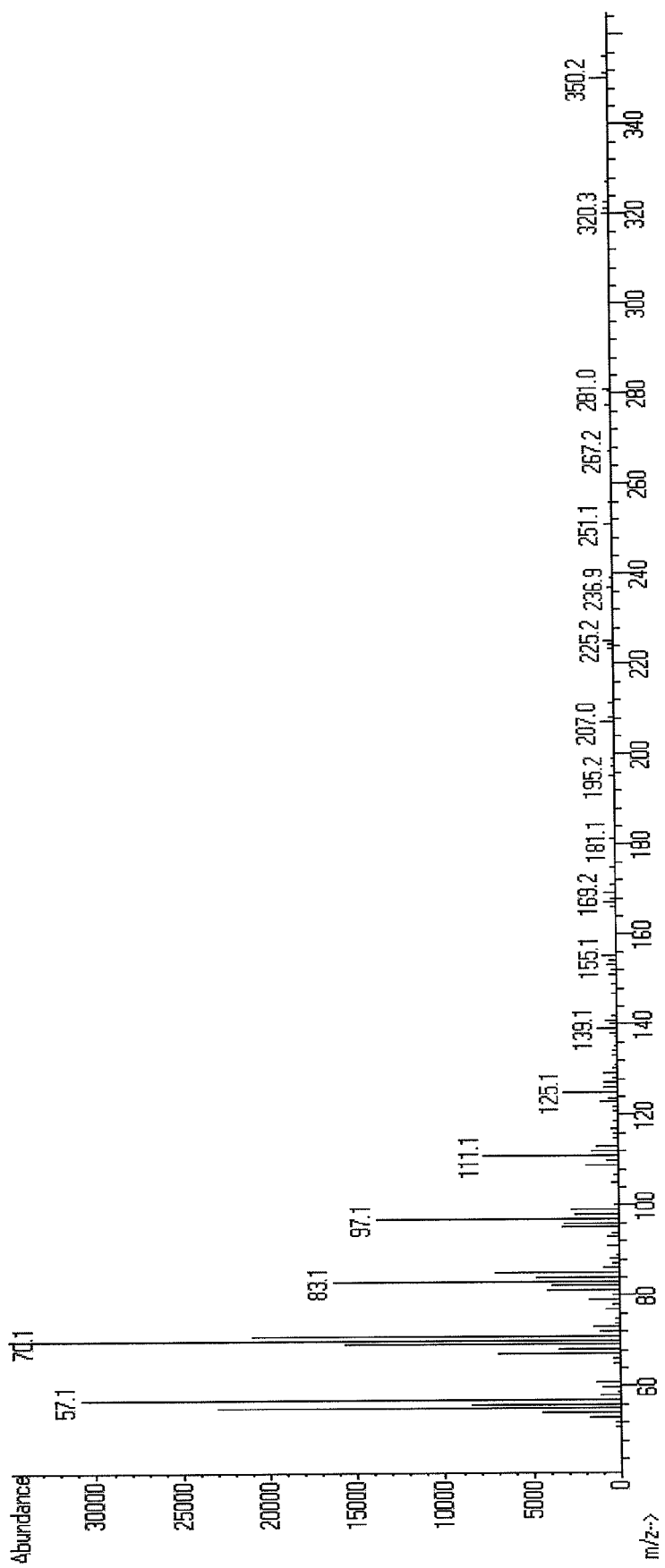
Figure 17C:
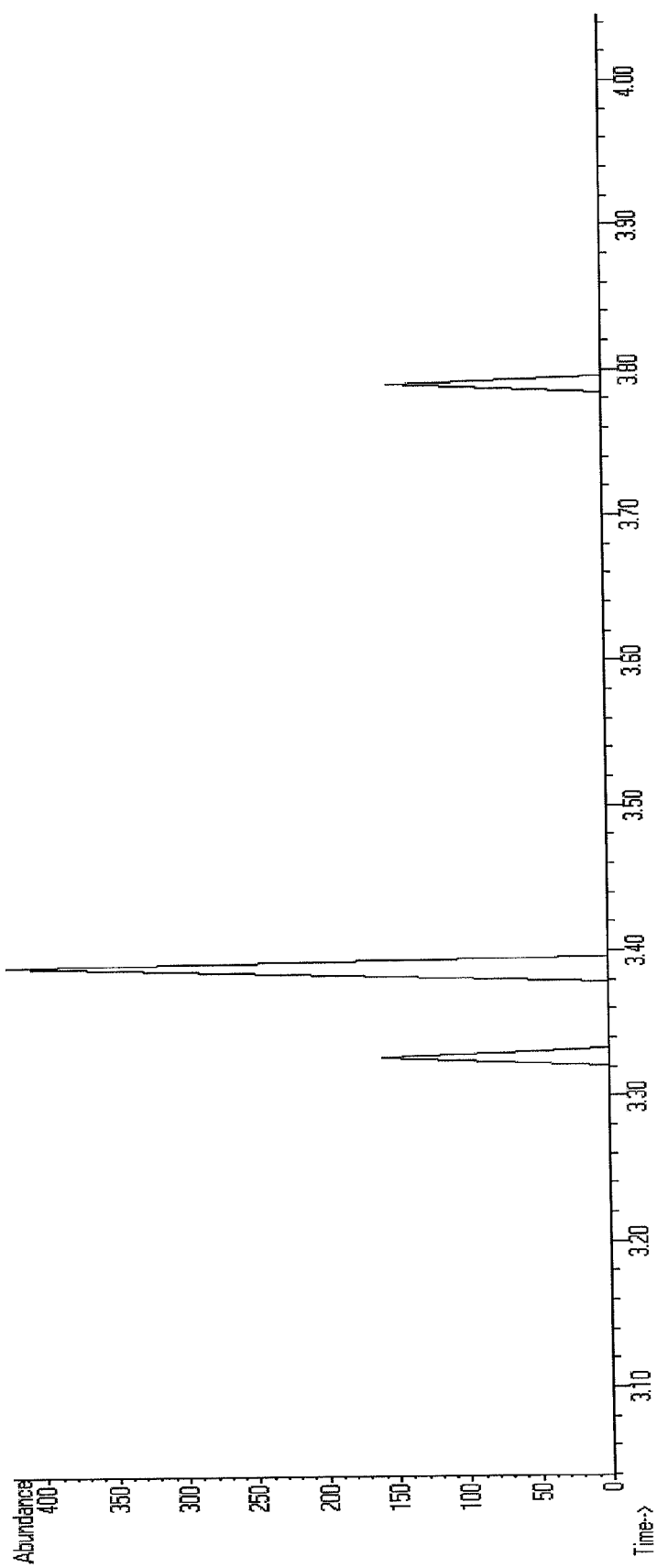
Figure 17D:
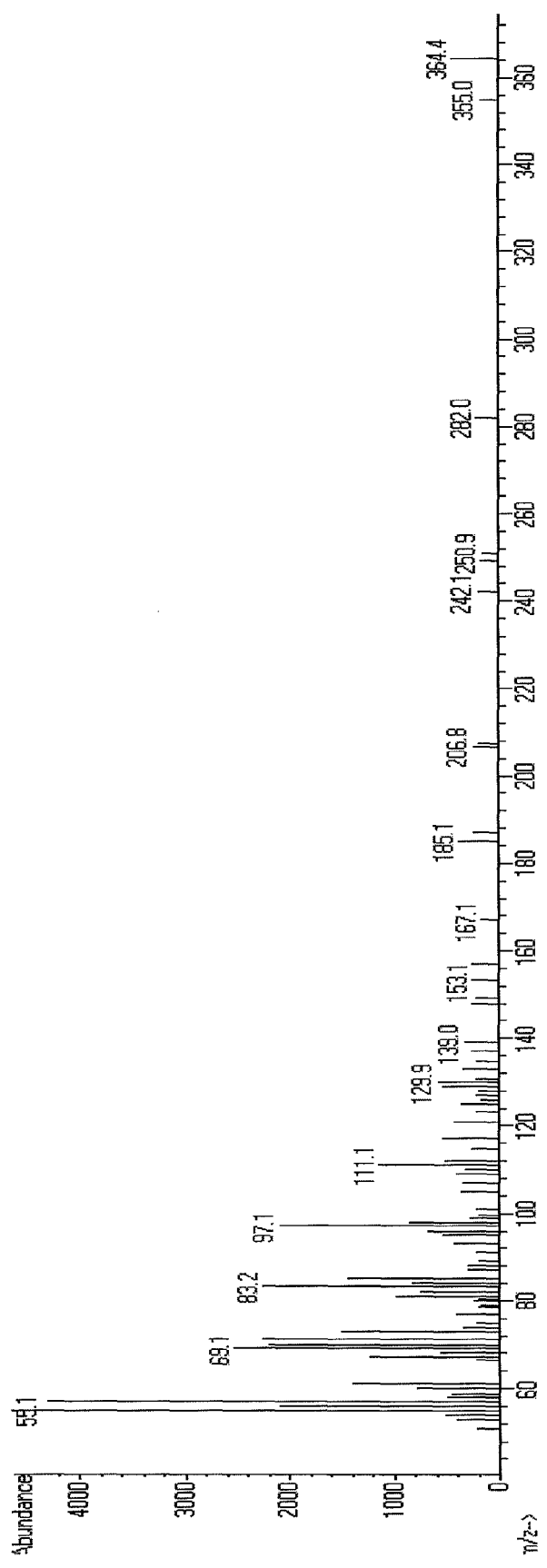
Figure 17E:
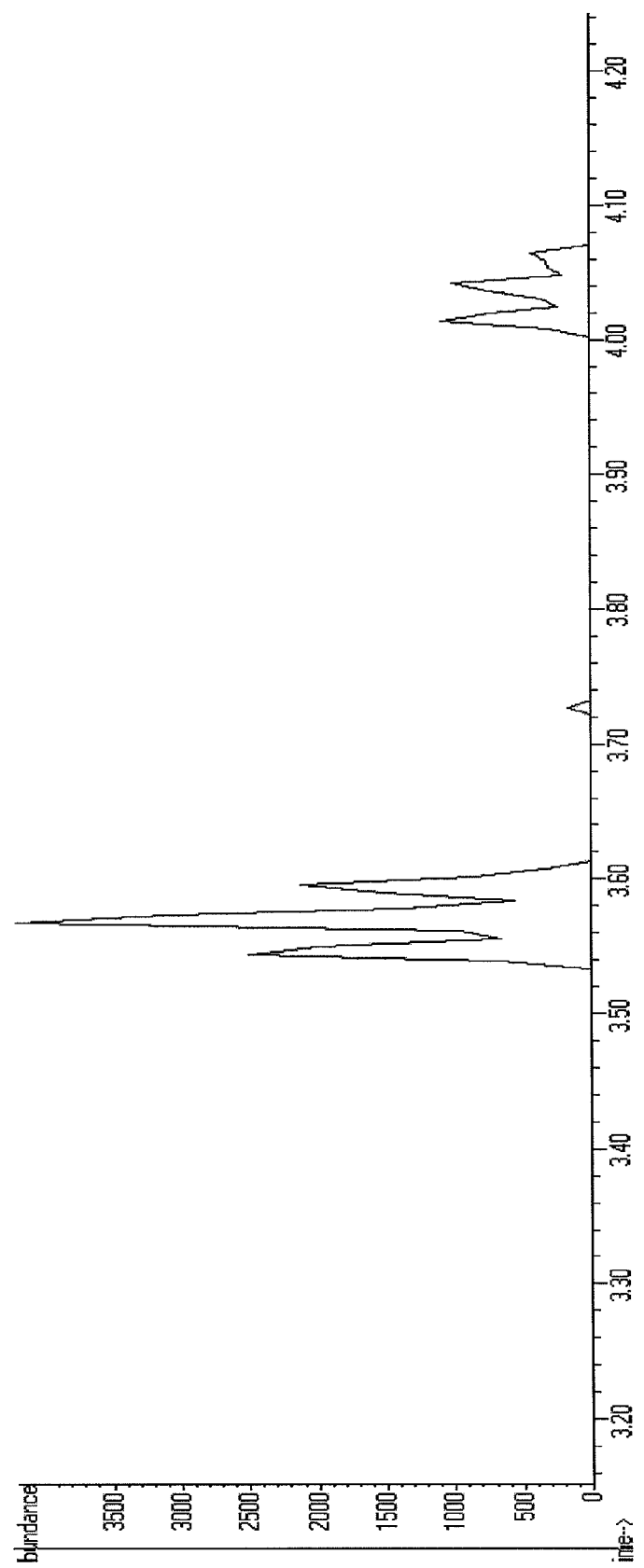
Figure 17F:
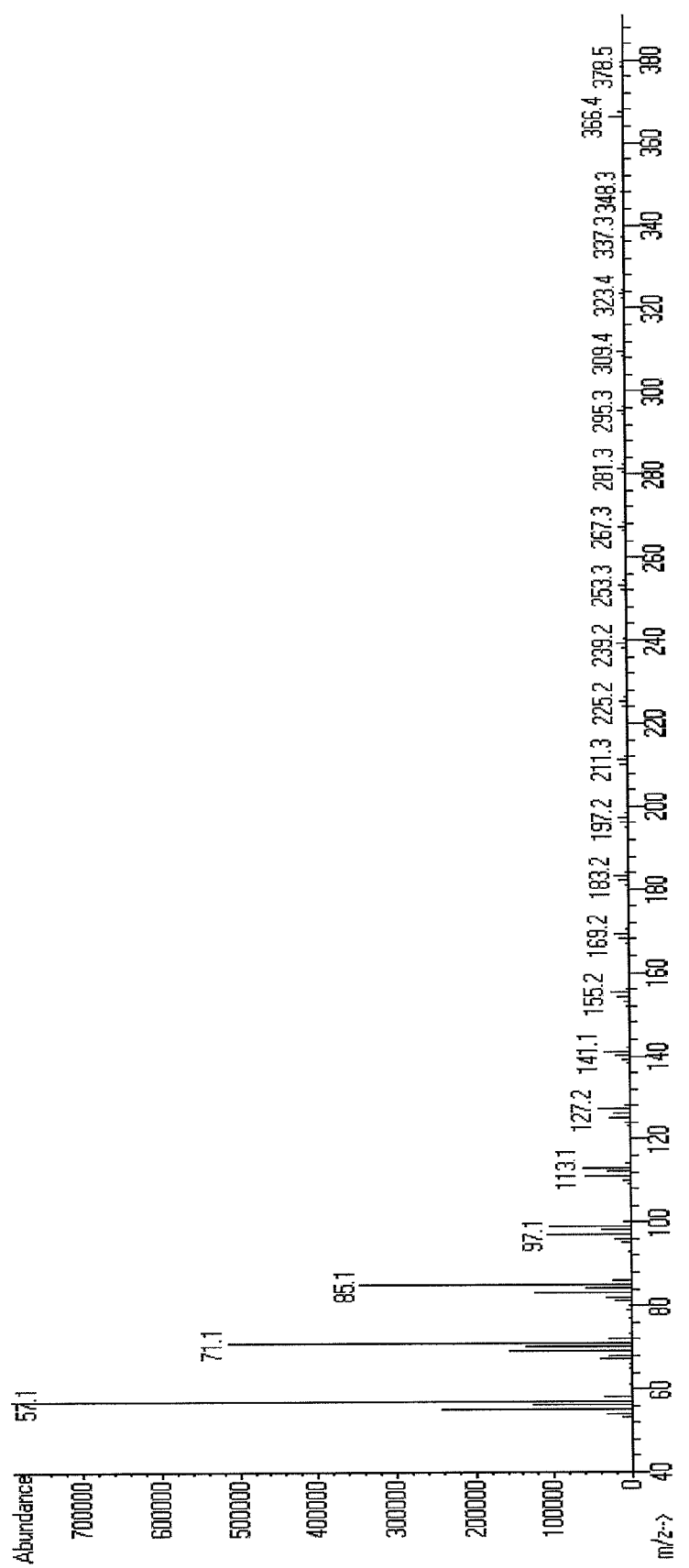
Figure 17G:
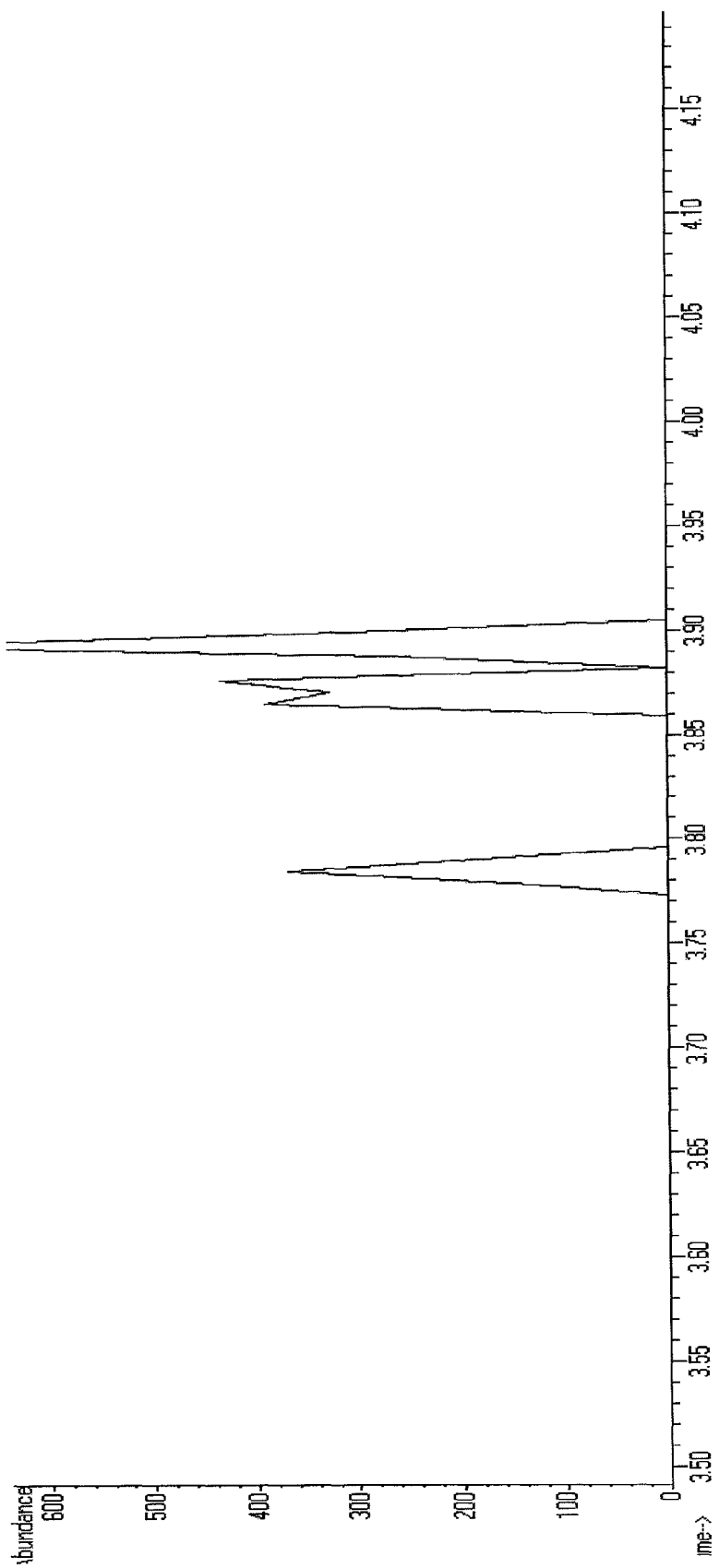
Figure 17H:
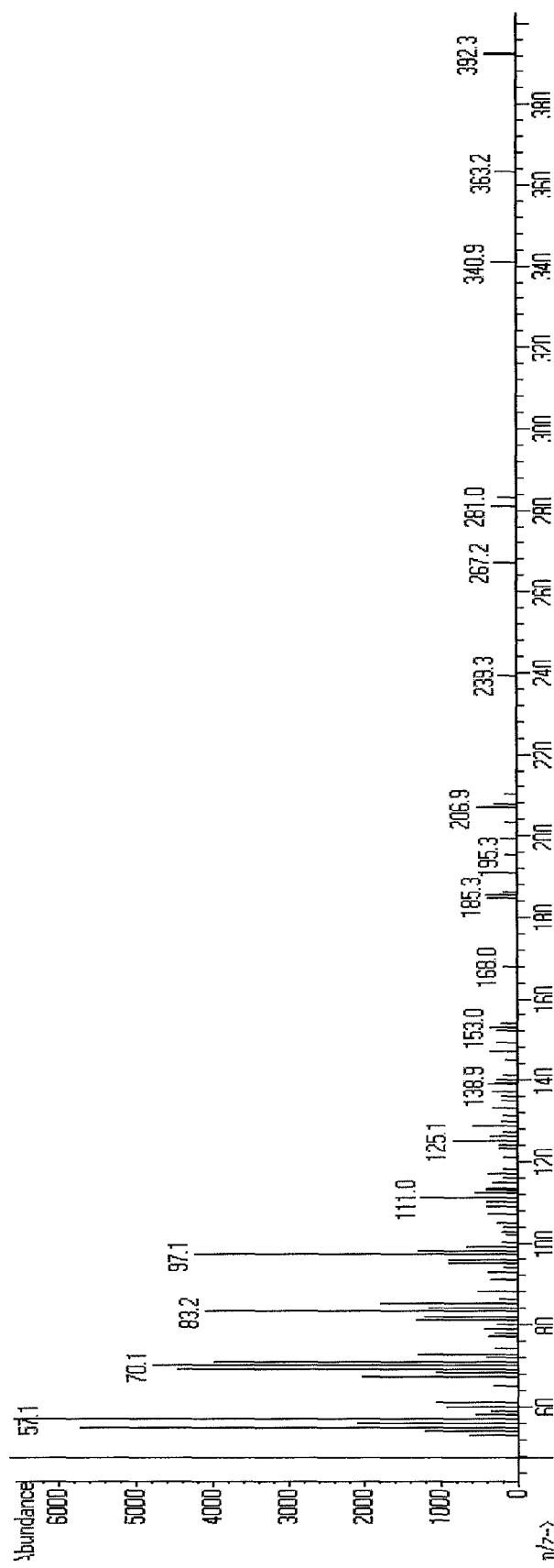
Figure 17I:
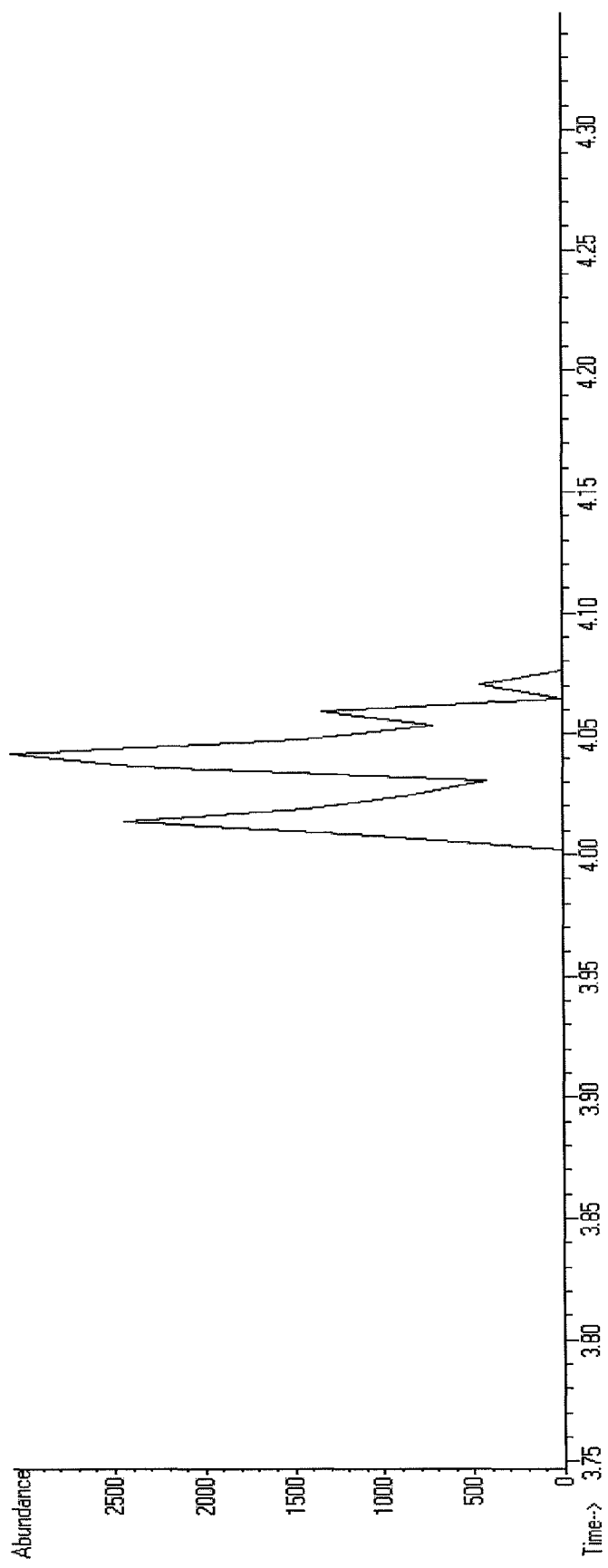
Figure 17J:
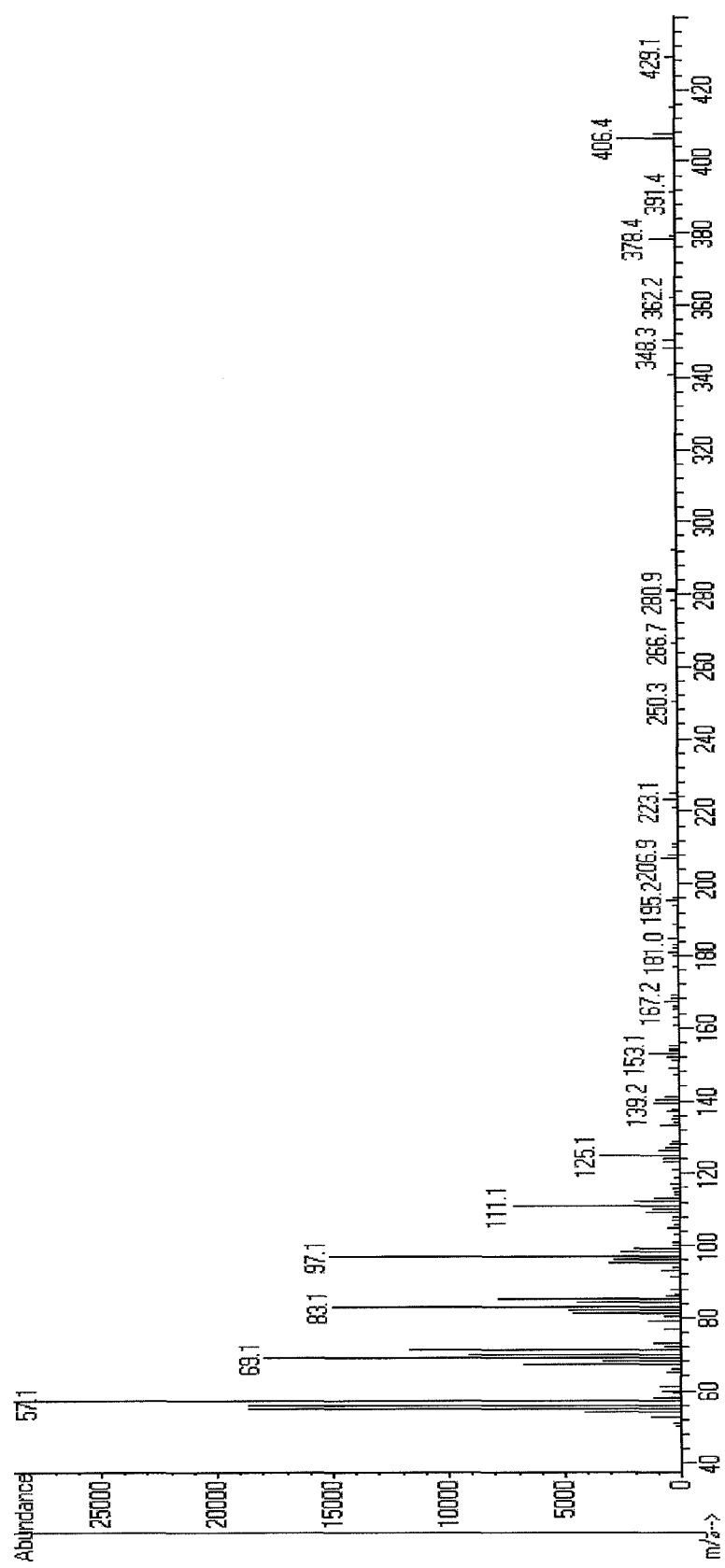
Figure 18A:
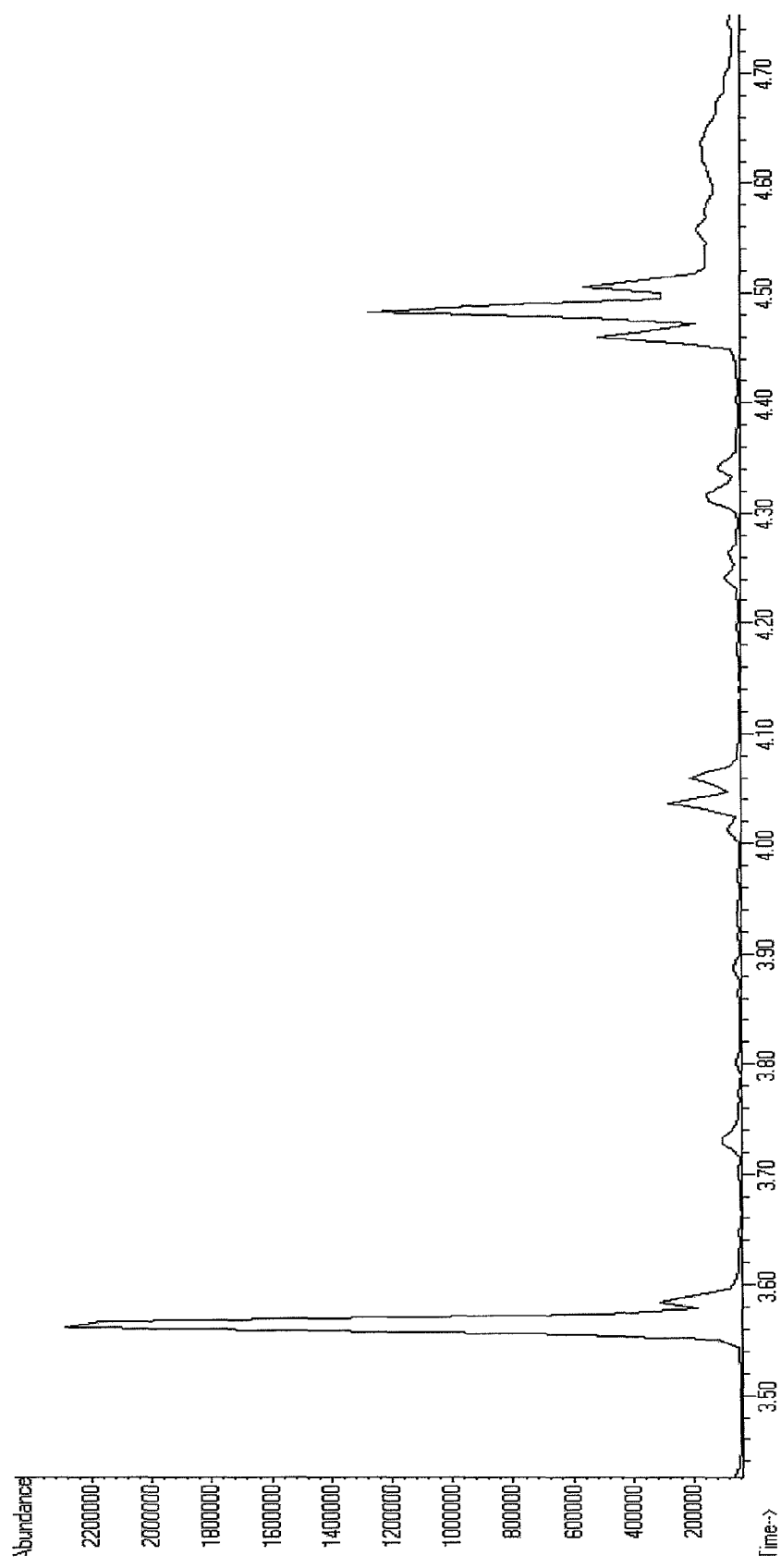
Figure 18B:
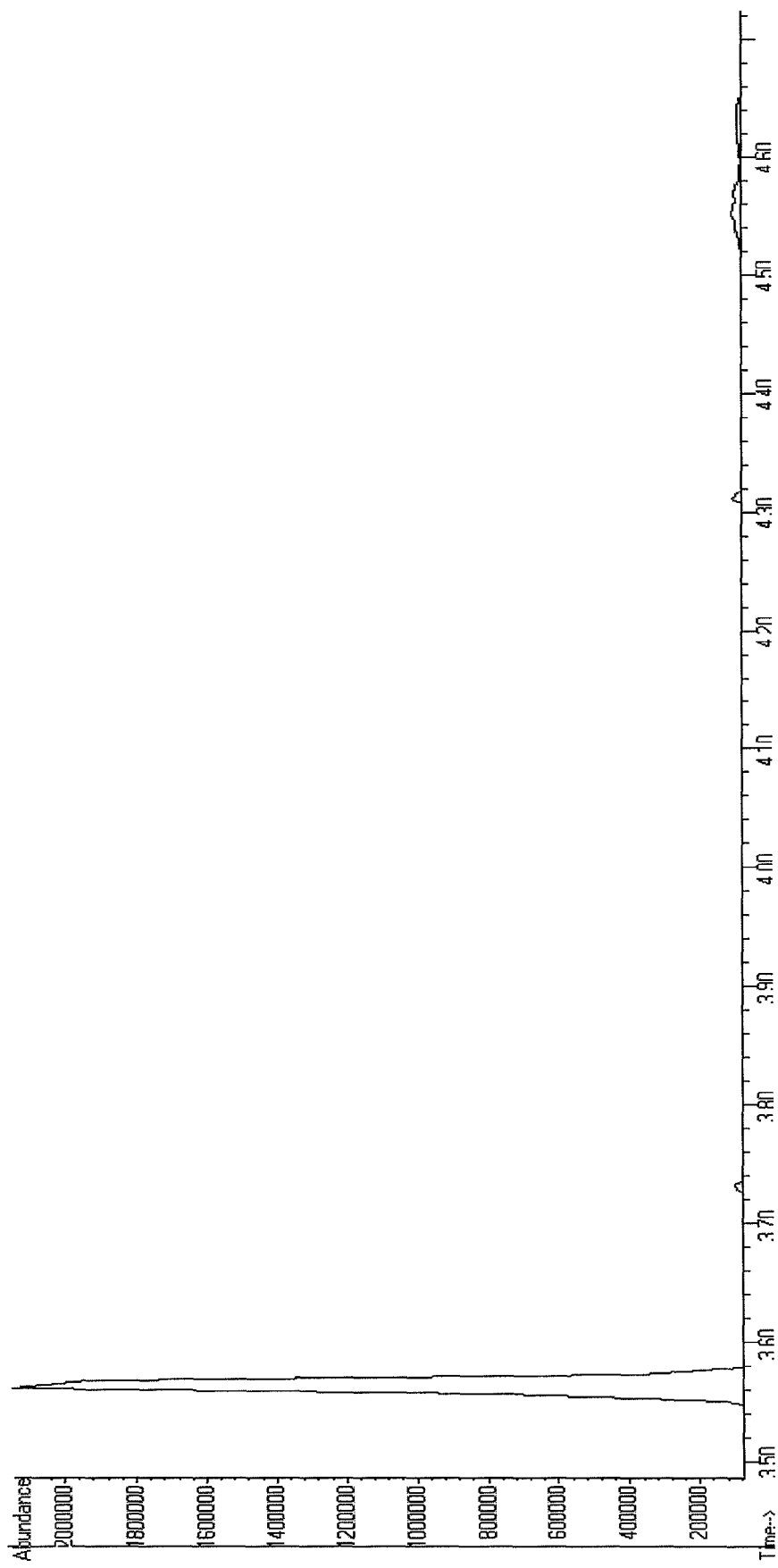
Figure 18C:
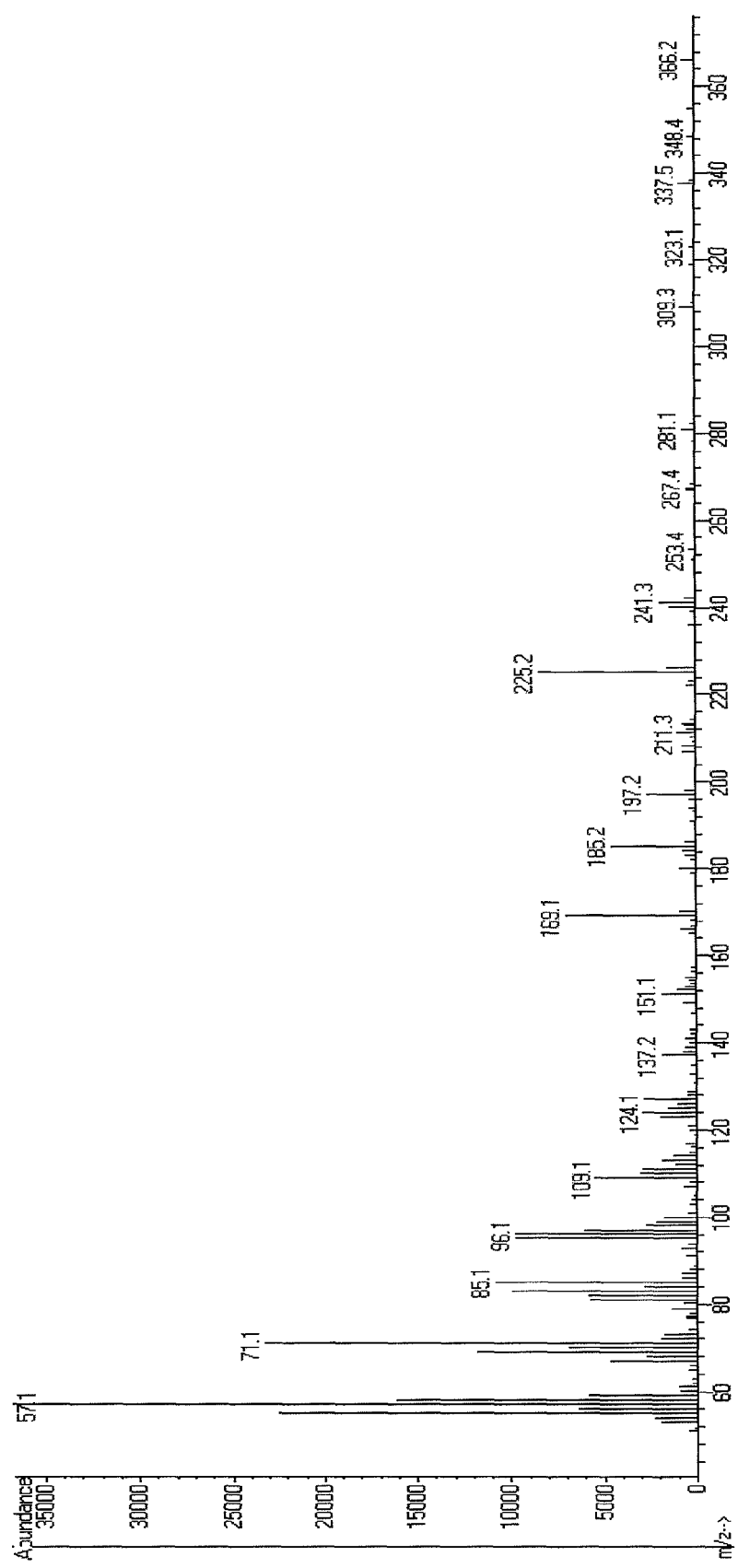
Figure 18D:
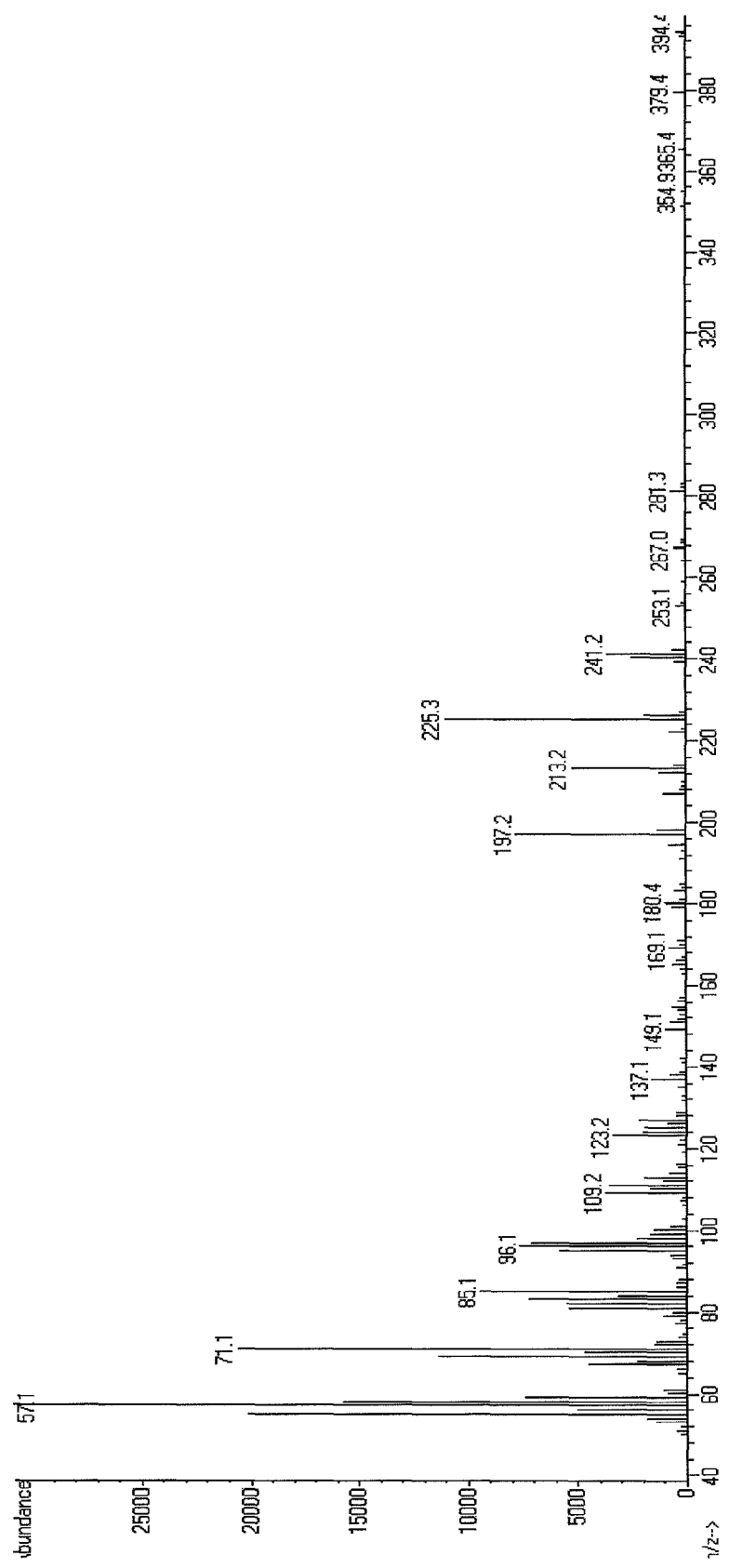
Figure 18E:
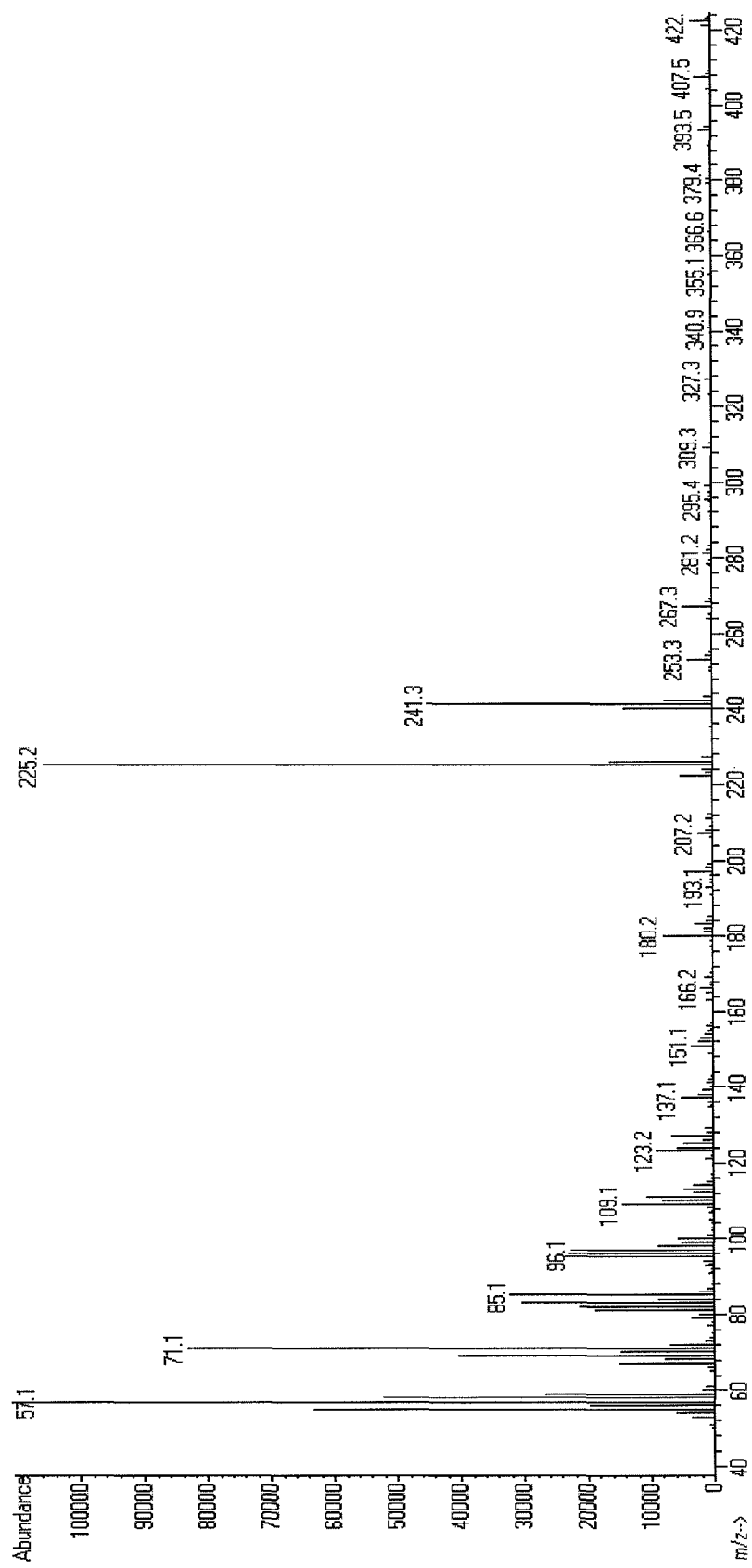

The resulting olefins detected by GC/MS were C27:1, C27:2, and C27:3 (see FIG. 16A-C). Table 28 shows the percent of C27:1 olefin produce by cell lysates from *E. coli* C41(DE3) transformed with pETDuetOleAOleB and pCOLADuetOle-COleD in the presence of C14-CoA or C14-ACP. The percent of C27:1 olefin was calculated by: [C27:1 peak area/(C27:1 peak area+C27:2 peak area+C27:3 peak area)]×100. The results shown in Table 28 indicate that addition of C14-CoA or C14-ACP to cell lysate from *E. coli* C41(DE3) transformed with pETDuetOleAOleB and pCOLADuetOleCOleD leads to an increase in the amount of C27:1 olefin. This indicates that *E. coli* C41(DE3) transformed with pETDuetOleAOleB and pCOLADuetOleCOleD present in the lysate can use C14-CoA or C14-ACP to form C27:1-olefin.

TABLE 28

|  | % of C27:1 in C27 alkenes |
| --- | --- |
| Lysate + C14-CoA | 47 |
| Lysate + C14-ACP | 41 |
| Lysate only | 24 |

The results of the experiments reflected in this example demonstrate that an in vitro assay comprising myristoyl-ACP or myristoyl coenzyme A in combination with OleA, OleB, OleC, and OleD can be used to synthesize olefins.

EXAMPLE 18

This example demonstrates that the OleA, OleB, OleC and OleD protein sequences can be used to identify organisms that naturally produce hydrocarbons.

The pBLAST bioinformatic program was used to identify protein sequences that belong to the OleA, OleB, OleC, and OleD protein families. A small number of organisms containing all four Ole protein sequences clustered together were identified (see, e.g., Table 1). Of these organisms, the following four organisms have been shown in the literature to produce the types of olefins described herein: *Stenotrophomonas maltophilia*, *Kineococcus radiotolerans*, *Chloroflexus* species, and various *Micrococcus* species, including the recently sequenced *Micrococcus luteus* (Tornabene et al., supra, Suen et al., supra, Morrison et al., supra; van der Meer et al., supra; Albro et al., supra; Philips et al., supra). To confirm that other organisms containing OleA, OleB, OleC, and OleD will naturally produce olefins, *Arthrobacter aurescens TC*1 (ATCC BAA-1386) from Table 1 was selected to test for olefin production. *Arthrobacter aurescens* TC1 has not been reported in the literature as producing olefins.

Figure 19A:
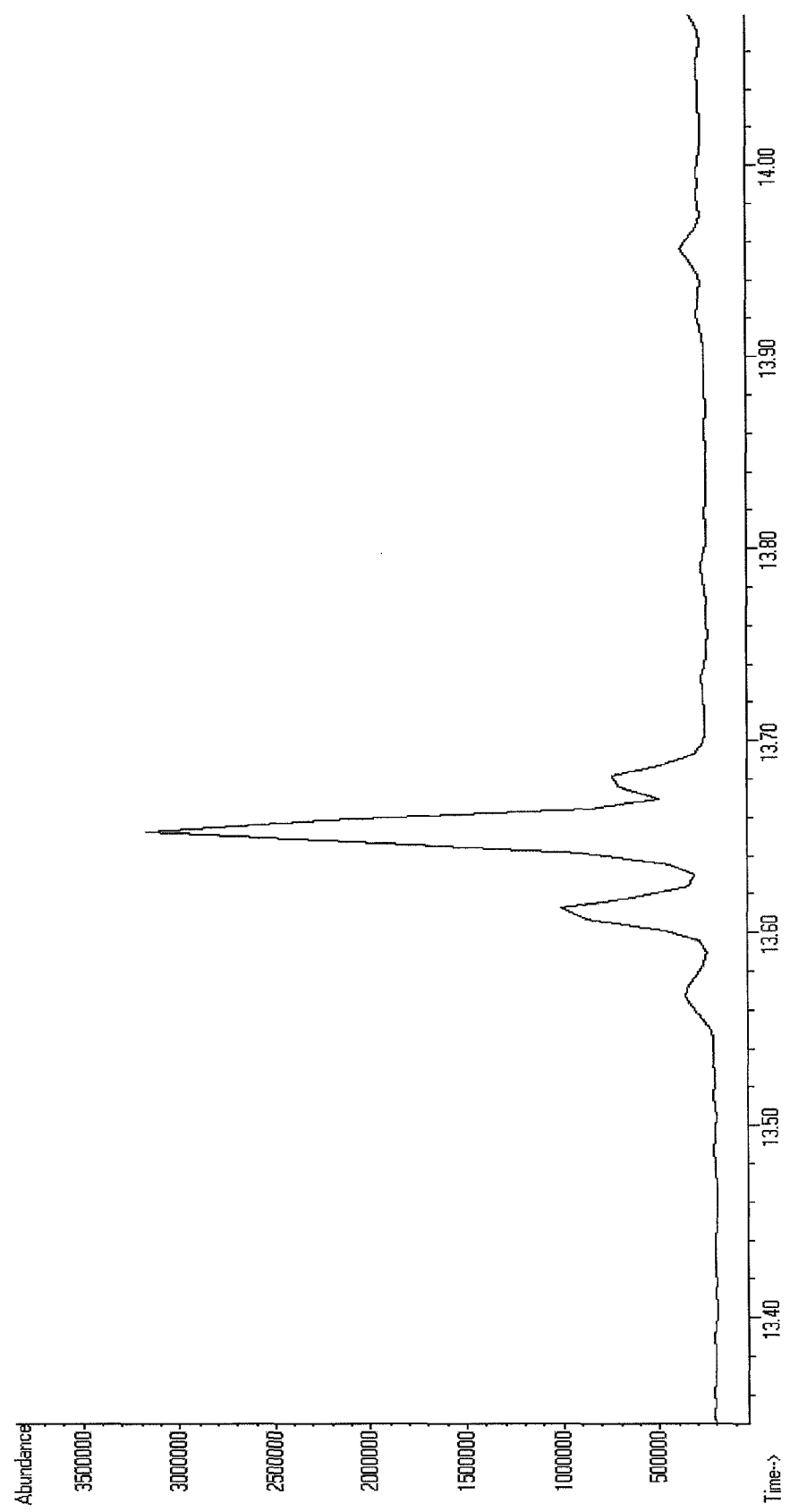
Figure 19B:
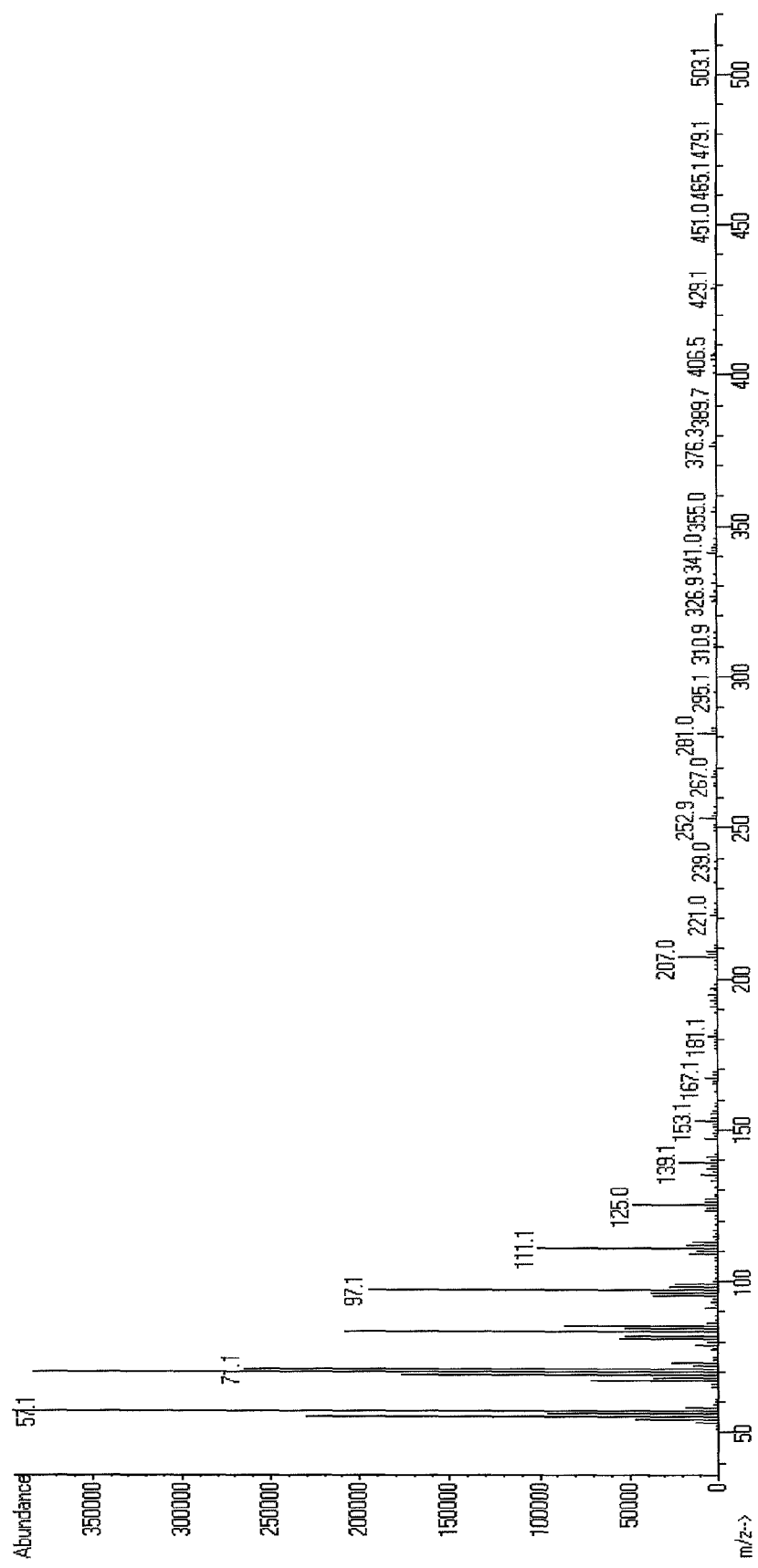

*Arthrobacter aurescens* TC1 was grown in 100 mL of *Corynebacterium* broth which is composed of 10 g casein peptone (tryptic digest), 5 g glucose, 5 g yeast extract, and 5 g NaCl per liter in a 500 mL flask with shaking at 30° C. for 48 hours. After 48 hours, 5 mL of the broth was extracted according to a modified Extraction Method 1. Specifically, after the initial pelleting of the cell culture the pellet was resuspended in 1 mL of water and recentrifuged to remove residual culture broth. The final pellet was resuspended in 100 µL of water. The remainder of Extraction Method 1 was followed (see Example 1). The extract was analyzed by GC/MS using Detection Method 1. The olefins detected by GC/MS were $C_{29}$ monounsaturated olefin (see FIG. 19A-B).

The results reflected in this example demonstrate that organisms with protein sequences for OleA, OleB, OleC, and OleD produce olefins. In addition, this example demonstrates that bioinformatics can be used to identify olefin producing organisms by identifying organisms with OleA, OleB, OleC, and OleD in their protein sequence. More specifically, this examples demonstrates that *Arthrobacter aurescens* TC1, which has the OleA, OleB, OleC, and OleD protein sequences, produces $C_{29}$ monounsaturated olefin.

EXAMPLE 19

This example demonstrates that biologically based olefins are distinguishable from petroleum based olefins. In particular, this example demonstrates that olefins produced by organisms, such as *E. coli* expressing the oleA, oleB, oleC, and oleD genes, can be distinguished from petroleum based olefins.

Purified biologically based olefins produced by fermentation of *E. coli* C41(DE3); pETDuet-1_OleAB; pCOLADuet-1_OleCD were compared to a petroleum based olefin, (Z)-9-Tricosene (97%, Sigma-Aldrich, CAS number: 27519-02-4), using standard carbon dating techniques. Samples were sent to Beta Analytic, Inc. (Miami, Fla., USA) for testing. The biologically based carbon content of the samples were measured using Accelerator Mass Spectrometry (AMS) based on ASTM D6866. The AMS measures the carbon isotope ratio of $^{13}C$ to $^{12}C$ and $^{14}C$ in graphite derived from the sample powders. The biologically based carbon content of the samples was then calculated from the carbon isotope ratio of $^{13}C$ to $^{12}C$ and the amount of $^{14}C$ present.

The olefin samples analyzed were produced and purified using the following method. *E. coli* C41(DE3); pETDuet-1_OleAB; pCOLADuet-1_OleCD was grown in 5 mL of LB medium supplemented with 100 mg/L carbenicillin and 50 mg/L kanamycin for 12 hours. This 12 hour culture was used to inoculate a larger culture comprised of 200 mL of F1 shake flask media containing: 3 g/L $KH_2PO_4$, 6.62 g/L $K_2HPO_4$, 4 g/L $(NH_4)_2SO_4$, 0.15 g/L $MgSO_4$, 5 g/L glucose (dextrose DX0145-5 EMD Chemicals, Inc. NJ), 1.25 mL/L of trace mineral solution, and 1.25 mL/L of trace vitamin solution supplemented with 100 mg/L carbenicillin and 50 mg/L kanamycin. The trace minerals solution contained per liter: 27 g $FeCl_3.6H_2O$, 2 g $ZnCl_2.4H_2O$, 2 g $CaCl_2.6H_2O$, 2 g $Na_2MoO_4.2H_2O$, 1.9 g $CuSO_4.5H_2O$, 0.5 g $H_3BO_3$, and 100 mL concentrated HCl. The trace vitamin solution contained per liter: 0.42 g riboflavin, 5.4 g pantothenic acid, 6 g niacin, 1.4 g pyridoxine, 0.06 g biotin, and 0.04 g folic acid. 50 mL of seed culture was used to inoculate a 2 L Biostat Aplus bioreactor (Sartorius BBI) which initially contained 1 L of sterilized F1 fermentation medium. The sterilized F1 fermentation medium contained: 1.5 g/L $KH_2PO_4$, 4.34 g/L $K_2HPO_4$ trihydrate, 4 g/L $(NH_4)_2SO_4$, 0.150 g/L $MgSO_4$ heptahydrate, 5 g/L sterile filtered glucose (dextrose EMD Chemicals, Inc. NJ), 1.25 mL/L of trace mineral solution, 1.25 mL/L of trace vitamin solution, and antibiotics at the same concentration as utilized in the shake flask. The pH of the culture was maintained at 7.2 using 1 M $H_2SO_4$ and 30% w/w $NH_4OH$. The temperature was maintained at 37° C., the aeration rate at 2 lpm (2 v/v/m), and the dissolved oxygen tension at 30% of saturation, utilizing an agitation loop cascaded to the DO controller. Foaming was controlled by the automated addition of an autoclaved solution of Antifoam 204 (Sigma-Aldrich St. Louis, Mo.). A nutrient feed composed of 60 g/L $(NH_4)_2SO_4$, 3.9 g/L $MgSO_4$ heptahydrate, 430 g/L glucose, 10 mL/L of the trace mineral solution, and 10 mL/L of the vitamin solution was provided under aerobic fermentation conditions for 48 hours in the fermentor. The glucose sugar source for the fermentations was derived from corn.

A nutrient feed composed of 60 g/L $(NH_4)_2SO_4$, 3.9 g/L $MgSO_4$ heptahydrate, 430 g/L glucose, 10 mL/L of the trace mineral solution, and 10 mL/L of the vitamin solution was provided when the glucose in the initial medium was depleted (approximately 6 hours following inoculation). The nutrient feed was gradually increased or decreased during the fermentation to maintain a residual glucose level in the medium of less than 10 g/L. Production of olefins in the bioreactor was induced when the culture attained an $OD_{600}$ of 30 AU (approximately 8-9 hours following inoculation) by the addition of a 1M IPTG stock solution to a final concentration of 1 mM. The temperature of the fermentation was also lowered at induction to 30° C. The bioreactor was harvested approximately 48 hours following induction.

After 48 hours, the fermentation cultures were centrifuged at 3500 rpm for 20 minutes (Allegra X-15R Centrifuge with rotor SX-4750A, Beckman Coulter, Fullerton, Calif.). The cell pellet was resuspended in 50 mL of sterile distilled water. 100 mL of methanol was added to the sample which was then sonicated in a sonicating water bath for 60 minutes. The mixture was transferred to a 1 L separation funnel where n-hexane was added to a final volume to 750 mL. The sample was mixed well by mild shaking after which the mixture sat to separate the hexane layer from the aqueous layer. Once the bilayer formed the lower aqueous layer was siphoned out of the separation funnel. $Na_2SO_4$ was added to the remaining organic layer to remove any excess $H_2O$ in the organic phase. The organic layer was then filtered two times through a Whatman #4 150 mm filter without applying a vacuum. The twice filtered organic phase was transferred into a round-bottom flask connected to a distillation column. Hexane and acetone were removed by distillation with the temperature set at 56° C. followed by 66-68° C. The remaining sample was black in color. To further purify the sample, the sample was filtered through a 200 mL silica gel 60 (particle size 0.063-0.300 mm, 70-230 mesh ASTM) column. The sample was removed from the column by elution with hexane. The hexane was removed from the olefin containing eluant by a rotary evaporator at ambient temperature. Magnesol D-sol (Dallas Group of American, Inc) was used in the final purification process. The sample was resuspended in methyl tert-butyl ether (MTBE) to a final volume of 8 mL. Magnesol was added to the sample in a 10:1 ratio of magnesol vs. sample (w/v). The sample-magnesol mixture was mixed for 1 hour at 37° C. on a rotary shaker. The mixture was filtered through a 0.2 μm PTFE filter into a 20 mL scintillation vial. The remaining solid was washed with 2.5 mL MTBE. The wash and filtered mixture were combined in a scintillation vial. The MTBE was evaporated in the chemical fume hood at ambient temperature.

$^{14}C$ was determined by AMS at Beta Analytic, Inc., using the ASTM D6866 method B. The biologically based carbon content was obtained by deriving the ratio of $^{14}C$ in the sample to that of a modern reference standard. The ratio is reported as a percentage with the units 'pMC' (percent modern carbon).

The modern reference standard used in radiocarbon dating is a NIST (National Institute of Standards and Technology) standard with a known radiocarbon content equivalent to approximately the year AD 1950. AD 1950 was chosen since it represents a time prior to thermo-nuclear weapons testing which introduced large amounts of excess $^{14}C$ into the atmosphere with each test (the excess $^{14}C$ is known as "bomb carbon"). For an archaeologist or geologist using $^{14}C$ dates, AD 1950 equals "zero years old". This also represents 100 pMC. "Bomb carbon" in the atmosphere reached almost twice the normal level in 1963 at the peak of thermo-nuclear weapons. Its distribution within the atmosphere has been approximated since its appearance, showing values that are greater than 100 pMC for plants and animals living since AD 1950. It has gradually decreased over time with today's value being near 107.5 pMC. This means that a fresh biomass material, such as corn, would give a $^{14}C$ signature near 107.5 pMC. Petroleum based compounds will have a pMC value of zero. Combining fossil carbon with present day carbon will result in a dilution of the present day pMC content. By presuming 107.5 pMC represents the $^{14}C$ content of present day biomass materials and 0 pMC represents the $^{14}C$ content of petroleum based products, the measured pMC value for that material will reflect the proportions of the two component types. For example, a material derived 100% from present day soybeans would give a radiocarbon signature near 107.5 pMC. If that material was diluted 50% with petroleum based products, it would give a radiocarbon signature of approximately 54 pMC.

A biologically based carbon content is derived by assigning 100% equal to 107.5 pMC and 0% equal to 0 pMC. For example, a sample measuring 99 pMC will give an equivalent biologically based carbon content of 93%. This value is referred to as the mean biologically based carbon result and assumes all the components within the analyzed material originated either from present day biological material or petroleum based material.

The stable carbon isotope ratio ($^{13}C/^{12}C$) in a given biologically derived material is a consequence of the 13C/$^{12}C$ ratio in atmospheric carbon dioxide at the time the carbon dioxide is fixed. It also reflects the precise metabolic pathway of the plant fixing carbon dioxide. The $^{13}C/^{12}C$ ratio is expressed normally as $\delta^{13}C$ which is calculated as follows:

$$\delta^{13}C(\text{‰})=[(^{13}C/^{12}C)_{sample}-(^{13}C/^{12}C)_{standard}]/(^{13}C/^{12}C)_{standard}\times 1000$$

The $\delta^{13}C$ of petroleum and $C_4$ plants (maize, sorghum, etc.) have a similar range (from –7 to –13 ppt), while $^{13}C/^{12}C$ of $C_3$ plants (wheat, oats, rice, etc.) falls in a range from –19 to –27 ppt (see, e.g., Stuiver et al., supra, and Gupta, et al., Radiocarbon dating practices at ANU. Handbook, Radiocarbon Dating Laboratory, Research School of Pacific Studies, ANU, Canberra (1985)). The difference of the $\delta^{13}C$ value for $C_4$ and $C_3$ plants is due to the different photosynthetic cycle of each plant.

The values of pMC and $\delta^{13}C$ of the biologically based olefin product and the petroleum based 9-tricosene are listed in Table 29.

TABLE 29

|  | pMC | $\delta^{13}C$ (‰) | Mean biobased content, % |
|---|---|---|---|
| Olefin product | 94.2 ± 0.4 | –12.3 | 88 |
| Cis-9-tricosene | 0 ± 0 | –30.5 | 0 |

Based on the $^{14}C$ results, the biologically based olefin produced by E. coli of has a carbon content which is at least 88% derived from biologically based carbon. It is possible that the residual MTBE, a petroleum based product used during purification, lowered the content of biologically based carbon in the olefin sample. Moreover, the $\delta^{13}C$ value of the biologically based olefin product provides additional evidence that the olefin product, and the carbon contained therein, is primarily derived from a biological source.

The results of the experiments reflected in this example demonstrates that biologically based hydrocarbons are distinguishable from petroleum based hydrocarbons. In particular, this example demonstrates that olefins produced by organisms, such as E. coli expressing the oleA, oleB, oleC, and oleD genes, can be distinguished from petroleum based olefins.

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Throughout the specification, a reference may be made using an abbreviated gene name or polypeptide name, but it is understood that such an abbreviated gene or polypeptide name represents the genus of genes or polypeptides. Such gene names include all genes encoding the same polypeptide and homologous polypeptides having the same physiological function. Polypeptide names include all polypeptides that have the same activity (e.g., that catalyze the same fundamental chemical reaction).

The accession numbers referenced herein are derived from the NCBI database (National Center for Biotechnology Information) maintained by the National Institute of Health, U.S.A. The accession numbers are as provided in the database on Apr. 15, 2007.

EC numbers are established by the Nomenclature Committee of the International Union of Biochemistry and Molecular Biology (NC-IUBMB) (available at http://www.chem.qmul.ac.ukhubmb/enzyme/). The EC numbers referenced herein are derived from the KEGG Ligand database, maintained by the Kyoto Encyclopedia of Genes and Genomics, sponsored in part by the University of Tokyo. The EC numbers are as provided in the database as of April, 2007.

Preferred embodiments of this invention are described herein, including the best mode known to the inventors for carrying out the invention. Variations of those preferred embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

SEQUENCE LISTING (496 sequences)

SEQ ID NO: 1 - DNA, 1017 bp, Stenotrophomonas maltophilia
atgctcttcaagaatgtctcgatcgccggcctggcacacgttgatgcgccgcatacgctgacgaccaaggaaatcaacgagcggctgcagccgacgttggatcgcctcggtatccgcaccgacgtgctcggcgatatcgccggcatccatgcccgccgcctgtgggacaacggcgtgcttgcgtccgatgccgccaccatggccggccgcaaggcgctggaagacgcgggcatcgatgcgacgcaggtcggcctgctggtcaacacctcggtcagccgcgactacctggagccgtccacggcctccatcgtgtcgggcaacctcggcgtcagcgacgagtgcatgaccttcgacgtcgccaatgcctgcctggccttcatcaacggcatggacatcgcggcgcgcatgatcgagcgcggcgacatcgactacgcgctggtggtggatggcgagaccgccaacctggtgtacgagaagaccctggagcgcatgaccgccccggacgtcaccgccgacgacttccgcaacgaactggcggcgctgaccaccggttcgggtgctgcggcgatggtgatggcgcgctcggagctggtgccggacgcgccgcgctacaagggcggtgtcacccgttcggccaccgagtggaaccagctgtgcctgggcaacctggaccggatggtcaccgacacccgcctgctgctgatcgaaggcatcaagctggcgcagaagaccttcagcgccgccaagatcgcactcggctgggctgtggaagaactggaccagttcgtgatccaccaggtcagccagccgcacaccgccgcgttcatcaagaacttcggcatcgacccgaagaaggtcatgaccatcttcggcgagcacggcaacatcggcccggcctcggtgccgatcgtgctgagcaagctcaagcagctgggcaagctgaagaagggcgatcgcatcgcgcttctgggcattggctcgggcctgaactgctcgatggctgaagtggtctggtaa

SEQ ID NO: 2 - protein, 338 aa, Stenotrophomonas maltophilia
MLFKNVSIAGLAHVDAPHTLTTKEINERLQPTLDRLGIRTDVLGDIAGIHARRLWDNGVLASDAATMAGRKALEDAGIDATQVGLLVNTSVSRDYLEPSTASIVSGNLGVSDECMTFDVANACLAFINGMDIAARMIERGDIDYALVVDGETANLVYEKTLERMTAPDVTADDFRNELAALTTGSGAAAMVMARSELVPDAPRYKGGVTRSATEWNQLCLGNLDRMVTDTRLLLIEGIKLAQKTFSAAKIALGWAVEELDQFVIHQVSQPHTAAFIKNFGIDPKKVMTIFGEHGNIGPASVPIVLSKLKQLGKLKKGDRIALLGIGSGLNCSMAEVVW

SEQ ID NO: 3 - DNA, 1017 bp, Stenotrophomonas maltophilia
atgttattcaaaaatgtatctatcgctggtctggctcatgtggatgctccgcataccctgaccaccaaggagatcaacgaacgcctgcaaccgacgctggatcgcctgggtatccgtaccgacgtactgggcgacatcgctggtatccacgcacgtcgtctgtgggacaatggcgtactggcttctgatgctgcaactatggcaggccgtaaagcactggaggacgctggtattaacgcgactcaggtaggcctgctggtaaacacctccgtaagccgcgattacctggagccttccaccgcctccattgtgtctggcaacctgggcgtgtctgatgaatgcatgaccttcgatgttgctaacgcttgcctggcattcattaacggtatggatatcgcagcacgcatgattgaacgcggtgacatcgattacgccctggtagtagacggtgaaaccgcaaatctggtgtacgaaaagaccctggaacgtatgactgcaccggatgtgactgcagatgacttccgtaacgagctggctgctctgaccaccggttctggcgcggcagcgatggtgatggctcgctccgagctggtccctgatgcgccgcgttacaagggtggtgtgacccgtagcgccaccgaatggaaccaactgtgtctgggtaacctggaccgtatggttaccgacactcgtctgctgctgatcgaaggtatcaagctggctcagaaaacctttaccgccgctaaaattgctctgggttgggcagtggaagaactggaccagttcgtgattcaccaggtcagccaaccgcacactgcggcgttcatcaagaacttcggtatcgaccctaaaaaggtgatgaccattttcggtgagcacggcaacatcggcccagcttctgtaccgatcgttctgtctaaactgaaacagctgggcaaactgaaaaagggcgaccgcatcgcgctgctgggcatcggtagcggcctgaactgtagcatggctgaggttgtgtggtaa

SEQ ID NO: 4 - protein, 338 aa, Stenotrophomonas maltophilia
MLFKNVSIAGLAHVDAPHTLTTKEINERLQPTLDRLGIRTDVLGDIAGIHARRLWDNGVLASDAATMAGRKALEDAGINATQVGLLVNTSVSRDYLEPSTASIVSGNLGVSDECMTFDVANACLAFINGMDIAARMIERGDIDYALVVDGETANLVYEKTLERMTAPDVTADDFRNELAALTTGSGAAAMVMARSELVPDAPRYKGGVTRSATEWNQLCLGNLDRMVTDTRLLLIEGIKLAQKTFTAAKIALGWAVEELDQFVIHQVSQPHTAAFIKNFGIDPKKVMTIFGEHGNIGPASVPIVLSKLKQLGKLKKGDRIALLGIGSGLNCSMAEVVW

SEQ ID NO: 5 - DNA, 1659 bp, Stenotrophomonas maltophilia
atgaaccgaccctgcaatattgccgcccgcttgcctgaactggcgcgtgaacggcccgaccagatcgccatccgctgcccgggccgccgtggcgccggcaacggcatggccgcctacgacgtgaccctggattaccgccagctggacgcccgcagcgacgccatggcggctggcctggcaggctacgggatcggtcgcggggtgcgcacggtggtgatggtgcggccgtcgccggagttcttcctgttgatgtttgccctgttcaaactgggtgcggtgccggtgctggtcgacccgggcatcgacaaacgcgcgctgaagcagtgcctggatgaggcgcagccggaggctttcattggcattccgctggcacacgtggcgcggttggcgctgcgctgggcgcgctcggcgacccgcctggtcaccgtcggccgccgcctcggctggggcgggaccacgctggccgcgctggagcgcgccggtgccaacgggggggcgatgctggccgccaccgatggcgaggacatggccgcgatcctgttcaccagcggctccaccggcgtgcccaagggcgtggtctaccgccaccgtcatttcgtcggccagatccagctgctgggcagtgcctttggcatggaagcgggcggggtggacctgccgaccttcccgccgtttgccttgttcgacccggcgctgggcctgacctcggtgatcccggacatggacccgacccggccggcacaggccgacccggcacgcctgcatgacgccatccagcgcttcggcgtgacccagctgtttggctcgcctgcgctgatgcgggtgctggcccgtcacggccggccgttgccgacggtgacccgggtgacctcggccggtgcgccggtgccgccggatgtggtcgccaccatccgcagcctgttgccggccgatgcgcagttctggaccccgtacggcgccaccgagtgcctgccggtggcggtggtggaaggccgcgagctggagcgcacccgtgccgccaccgaggccggtgccggtacctgcgtgggcagcgtggttgaaccgaatgaggtgcgcatcatcggcatcgatgacggaccgttggccgactggtcgcaggcgcgcgtgctggccaccggcgaggtgggcgagatcaccgtggccggaccgaccgctaccgacagttacttcaaccgcccgcaggccaccgcggcggcgaagatccgcgagaccctggccgatggcagcacgcgcgtggtgcaccgcatgggtgacgtgggctacttcgatgcgcagggccgcctgtggttctgcggccgcaagacccatcgcgtggaaaccgcacgggggccgctgtacaccgaacaggtggagccggtgttcaataccgtgcccggggtggcgcgcacggcgctggtcggtgttggtccggcgggagcacaggtgccggtgctgtgcgtggagctgcagcgtggccagtcagacagcccggcgctgcaggaggcgctgcgtgcgcacgccgcagcccgcgcaccggaagccggcctgcagcacttcctggtgcatccggcgttccccgtcgatatccgtcacaacgccaagatcggccgcgagaagctcgccgtctgggccagcgccgaactggagaagcgcgcatga

SEQ ID NO: 6 - protein, 552 aa, Stenotrophomonas maltophilia
MNRPCNIAARLPELARERPDQIAIRCPGRRGAGNGMAAYDVTLDYRQLDARSDAMAAGLAGYGIGRGVRTVVMVRPSPEFFLLMFALFKLGAVPVLVDPGIDKRALKQCLDEAQPEAFIGIPLAHVARLALRWARSATRLVTVGRRLGWGGTTLAALERAGANGGAMLAATDGEDMAAILFTSGSTGVPKGVVYRHRHFVGQIQLLGSAFGMEAGGVDLPTFPPFALFDPALGLTSVIPDMDPTRPAQADPARLHDAIQRFGVTQLFGSPALMRVLARHGRPLPTVTRVTSAGAPVPPDVVATIRSLLPADAQFWTPYGATECLPVAVVEGRELERTRAATEAGAGTCVGSVVEPNEVRIIGIDDGPLADWSQARVLATGEVGEITVAGPTATDSYFNRPQATAAAKIRETLADGSTRVVHRMGDVGYFDAQGRLWFCGRKTHRVETARGPLYTEQVEPVFNTVPGVARTALVGVGPAGAQVPVLCVELQRGQSDSPALQEALRAHAAARAPEAGLQHFLVHPAFPVDIRHNAKIGREKLAVWASAELEKRA

SEQ ID NO: 7 - DNA, 993 bp, Stenotrophomonas maltophilia
atgaagatcctggtcaccggtggtggtggtttccttggccaggcgctgtgccgtgggctggtcgaacgtggccaccaggtgctggcgttcaaccgcagccactacccggaactgcaggccatgggcgtgggccagatccgcggcgatctggccgatgcgcaggcggtgctgcatgcagtggccggcgtcgatgcggtatttcacaacggcgccaaggccggcgcctggggcagctatgacagctaccaccaggccaacgtggtcggcaccgacaacgtgatcgccgcctgccgcgcgcacggcatcagccggctggtctacacctccacgcccagcgtgacccaccgcgcgacccacccggtggaaggcctgggggctgatgaggtgccgtacggcgaggacttccaggcgccgtatgcggcgaccaaggcgattgccgaacagcgcgtgctggccgccaacgatgccacgctggcgacggtggcgctgcgcccgcgcctgatctggggcccgggcgatcagcaactggtgccacgcctggcagaacgtgcgcggcagggccgcctgcgtctggtgggcgatggcaacaacaaggtggataccacttacatcgacaacgccgcgctcgcgcatttcctcgccttcgaagcgttggcaccgggtgccgcgtgtgcgggcaaggcctacttcatttccaacggcgaaccgctgcccatgcgcgagctggtcaacaagctgctggccgcggttggcgcgccgacggtggacaaggcgatcagtttcaagaccgcctatcgcatcggtgcggtctgcgagcggctgtggccgctgctgcgcctgcgtggcgagccgccgctgacccgcttcctggccgagcagctgtgcacgccgcactggtacagcatggagccggcgcgccgtgacttcggctacgtgccgcaggtcagcattgaagaagggctgcgcaggctgaaggcttcatctgccgcatag

SEQ ID NO: 8 - protein, 330 aa, Stenotrophomonas maltophilia
MKILVTGGGGFLGQALCRGLVERGHQVLAFNRSHYPELQAMGVGQIRGDLADAQAVLHAVAGVDAVFHNGAKAGAWGSYDSYHQANVVGTDNVIAACRAHGISRLVYTSTPSVTHRATHPVEGLGADEVPYGEDFQAPYAATKAIAEQRVLAANDATLATVALRPRLIWGPGDQQLVPRLAERARQGRLRLVGDGNNKVDTTYIDNAALAHFLAFEALAPGAACAGKAYFISNGEPLPMRELVNKLLAAVGAPTVDKAISFKTAYRIGAVCERLWPLLRLRGEPPLTRFLAEQLCTPHWYSMEPARRDFGYVPQVSIEEGLRRLKASSAA

SEQ ID NO: 9 - DNA, 891 bp, Stenotrophomonas maltophilia
atgtcccagcttcccggttaccccgcccacccgcagcgcttcgaggtacgccccggcctgtcgatgaactatctcgacgaaggcccgcgcgatggcgaagtggtggtgatggtgcacggcaacccgtcgtggagctattactggcgcacgctggtcgccggcctgtcggacacgtaccgctgcatcgtgccggaccacatcggcatgggcctgtcggacaagcccgatgacagccgctacgagtacacgctgcagtcgcgcgttgacgacctcgatgcgctgctcaagcatctgggcataaccggcccggtgaccctggcggtgcacgactggggcggcatgatcggtttcggctgggcgctgtcgcaccacgaccaggtcaagcgcctggtggtgctcaataccgctgcattcccgatgccggcggcgaagaagatgccgtggcagatcgcgctgggccgccactggaagatcggcgagtggatcatccgcaccttcaacgcgttctcctccggtgcctcgtggctgggcgtggagcggaagatgccggccgacgtgcgccgcgcctacgtgtcgccgtacaacagctgggccaaccgcatcagcaccatccgcttcatgcaggacatcccgctgtcgccggccgacaaggcgtggtcgctgctggagcatgccggcaaggcgctgccgtcgttcgccgaccggccggccttcctcggctggggcctgcgcgacttcgtgttcgaccaccacttcctgaagggcttccaggccgcgctgccgcaggcccaggtacatgcgttcgaggacgccggccactacgtgctggaagacaagcacgaagtgctggtgccggaaatccgcgcgttcctggacaagaacccgatctga

SEQ ID NO: 10 - protein, 296 aa, Stenotrophomonas maltophilia
MSQLPGYPAHPQRFEVRPGLSMNYLDEGPRDGEVVVMVHGNPSWSYYWRTLVAGLSDTYRCIVPDHIGMGLSDKPDDSRYEYTLQSRVDDLDALLKHLGITGPVTLAVHDWGGMIGFGWALSHHDQVKRLVVLNTAAFPMPAAKKMPWQIALGRHWKIGEWIIRTFNAFSSGASWLGVERKMPADVRRAYVSPYNSWANRISTIRFMQDIPLSPADKAWSLLEHAGKALPSFADRPAFLGWGLRDFVFDHHFLKGFQAALPQAQVHAFEDAGHYVLEDKHEVLVPEIRAFLDKNPI

SEQ ID NO: 11 - DNA, 1017 bp, Xanthomonas axonopodis
atgttatttcagaatgtttctatcgcaggcctggcccacgttgatgctccgcacactctgaccagcaaagaaattaacgaacgtctgcagccgacttacgaccgtctgggcatcaagaccgacgttctgggtgacgtagctggtatccacgcgcgtcgtctgtgggaccaggatgttcaggcgagcgacgcggctacccaggcagctcgtaaagcactgatcgacgctggtatcggcatcgagaagatcggtctgctggttaacacgagcgtttcccgtgactatctggagccgtccacggcgtccatcgttagcggcaacctgggcgtaggcgaccactgcgttacctttgacgttgctaacgcatgtctggcattcatcaacggcatggatatcgctgctcgtatgctggaacgtggcgagatcgattacgccctggtagttgatggcgagacggcgaacctggtgtatgagaaaaccctggagcgcatgacttccccggacgttactgaagaagagttccgtaacgaactggccgcgctgaccctgggctgcggtgcggctgcgatggttatggcgcgtaccgagctggtcccggatgcgccgcgttacaaaggtggtgttacccgtagcgcaacggagtggaacaaactgtgccgtggtaacctggaccgcatggtaactgacacccgtctgctgctgatcgagggcatcaaactggctcagaaaaccttcatggcagctcgccaagtcctgggttgggctgttgatgaactggatcagtttgtgatccatcaggtttcccgtccgcacacggctgctttcgttaaatcctttggtattgatccggctaaagtgatgactatcttcggcgaacacggcaacatcggtccggcctctgttccgattgttctgtctaaactgaaagaactgggtcgtctgaagaaaggtgatcgtatcgcgctgctgggcatcggcagcggcctgaactgcagcatggccgaagtggtttggtaa

SEQ ID NO: 12 - protein, 338 aa, Xanthomonas axonopodis
MLFQNVSIAGLAHVDAPHTLTSKEINERLQPTYDRLGIKTDVLGDVAGIHARRLWDQDVQASDAATQAARKALIDAGIGIEKIGLLVNTSVSRDYLEPSTASIVSGNLGVGDHCVTFDVANACLAFINGMDIAARMLERGEIDYALVVDGETANLVYEKTLERMTSPDVTEEEFRNELAALTLGCGAAAMVMARTELVPDAPRYKGGVTRSATEWNKLCRGNLDRMVTDTRLLLIEGIKLAQKTFMAARQVLGWAVDELDQFVIHQVSRPHTAAFVKSFGIDPAKVMTIFGEHGNIGPASVPIVLSKLKELGRLKKGDRIALLGIGSGLNCSMAEVVW

SEQ ID NO: 13 - DNA, 1680 bp, Xanthomonas axonopodis
atggctactactctgtgtaatattgctgctactctgcctcaactggctcgtgagcgcccggaccaaatcgctatccgttgtccgggcggtcgcggcgcaaacggctttgcagcttatgacgttaccctgtcttacgctgagctggacgcacgctctgatgccatcgcggctggtctggctcgtcacggtattggtcgcggtgctcgcgcagtggtaatggttcgcccgagcccggagttcttcctgctgatgtttgctctgttcaaagctggtgcagtgccggttctggttgatccgggtatcgacaaacgcgcgctgaagcagtgtctggacgaagcccagccgcaggcgttcattggcattgcgctggcgcagctggctcgccgtctgctgcgctgggcccgtagcgccacccagattgtcactgtaggcggccgttatggctggggcggtgttactctggcgcgtgtagagcgtgatggtgccggtgctggttcccagctggctgatacggcgccagacgatgttgccgcaatcctgttcacgtccggttccactggtgtaccaaagggcgtagtctaccgtcaccgtcactttgtgggccagatcgagctgctgcgcaacgcgtttggtatgcagcctggcggcgtagatctgccgactttcccgccgttcgccctgttcgatccagcactgggtctgacctctgtgattccagatatggacccaacccgccctggctccgcggacccgcgcaaactgcatgacgctatcaaccgtttcggcgttacccaactgttcggttctccggcgctgatgcgtgtactggcagactacggtcagccgctgccgaacgtccgtctggcgacgtccgcgggtgctccggttccgccggatgttgtggctaaaatccgtgcgctgctgcctgcggatgctcagttttggactccgtatggtgccaccgagtgtctgccggttgcagcaatcgagggccgtacgctggacgctactcgtgcagcgaccgaggccggcgcaggcacctgtgtcggtcacgttgtaccgccgaaccaggtacgtattatcgcaattgacgatgcggcaatcgcagactggagcggtgtccgtgagctggcaaccggtgaagttggcgagatcacggtagccggccctacggcgaccgacacctactttaaccgcgacgcagcaactcgtattgcaaaaatccgcgagtgctgctctgacggctctgagcgtgtcgtacaccgtatgggcgatgttggctacgtcgacgctgaaggccgtctgtggttctgtggtcgcaagacccaccgtgtagaggccgcctctggcccgctgtacaccgagcaggtcgaaccggtcttcaacgtacaccgccaggtccgtcgcactgccctggttggtgttggcgcacctggtcaacagcaaccggttctgtgcgtggaactgcagccaggcgtatctgcgtctgctttcgcacaggtagagtccgatctgcgtgcactgggcgccgctcacccgcataccgcgggtgttgcgcgcttcctgcgtcattctggcttccctgtcgacatccgtcacaacgccaaaatcggccgtgaaaccctggctgtttgggcggctcagcaactgcacaagcgtggcaagcttgcggccgcataa

SEQ ID NO: 14 - protein, 559 aa, Xanthomonas axonopodis
MATTLCNIAATLPQLARERPDQIAIRCPGGRGANGFAAYDVTLSYAELDARSDAIAAGLARHGIGRGARAVVMVRPSPEFFLLMFALFKAGAVPVLVDPGIDKRALKQCLDEAQPQAFIGIALAQLARRLLRWARSATQIVTVGGRYGWGGVTLARVERDGAGAGSQLADTAPDDVAAILFTSGSTGVPKGVVYRHRHFVGQIELLRNAFGMQPGGVDLPTFPPFALFDPALGLTSVIPDMDPTRPGSADPRKLHDAINRFGVTQLFGSPALMRVLADYGQPLPNVRLATSAGAPVPPDVVAKIRALLPADAQFWTPYGATECLPVAAIEGRTLDATRAATEAGAGTCVGHVVPPNQVRIIAIDDAAIADWSGVRELATGEVGEITVAGPTATDTYFNRDAATRIAKIRECCSDGSERVVHRMGDVGYVDAEGRLWFCGRKTHRVEAASGPLYTEQVEPVFNVHRQVRRTALVGVGAPGQQQPVLCVELQPGVSASAFAQVESDLRALGAAHPHTAGVARFLRHSGFPVDIRHNAKIGRETLAVWAAQQLHKRGKLAAA

SEQ ID NO: 15 - DNA, 1029 bp, Xanthomonas axonopodis
atggctaaagtactggttaccggtggtggtggttttctgggtcaagcactgtgccgtggtctgcgcgcacgtggtcacgaggttgtttcttttcagcgtggtgactacccggtactgcaacgtctgggtgttggccagattcgtggcgacctggccgatccgcaggcggtgcgtcacgcatttgccggcattgatgcagtcttccacaacgcggcaaaagcgggtgcgtggggttcctatgatagctaccaccaagccaacgtagttggtactcaaaacgtgatcgaagcatgtcgcgcaaacggcgttccgcgtctgatctacacctccaccccgtccgtaactcatcgtgcgaccaacccagtagagggtctgggcgcggatgaggttccgtatggtgatgacctgcgtgcggcgtacgcagctactaaagccatcgcggaacgtgctgtactggcggcaaacgacgctcagctggcaaccgtagcgctgcgtccgcgcctgatctggggtccgggcgataaccatctgctgccacgtctggctgcccgtgcacgcgcgggccgtctgcgtatggttggtgatggtggcaacctggtagactctacctatatcgataacgcggcgcaggcgcacttcgatgcgtttgaacatctggcggttggtgctgcctgcgctggccgtgcttactttatctccaacggcgaaccgctgccgatgcgtgaactgctgaaccgtctgctggcggctgtcgatgcgccggcagtcacctgcagcctgtctttcaacactgcataccgtattggtgctgtttgtgagacgctgtggcctctgctgcgcctgccgggtgaggtaccgctgactcgtttcctggttgaacagctgtgtactccgcactggtactctatggaaccggcccgtcgcgatttcggctatgtaccgcgcatctctatcgaggagggtctgcagcgtctgcgttcttctagctccaacgatatcgccattactcgtaagcttgcggccgcataa

SEQ ID NO: 16 - protein, 342 aa, Xanthomonas axonopodis
MAKVLVTGGGGFLGQALCRGLRARGHEVVSFQRGDYPVLQRLGVGQIRGDLADPQAVRHAFAGIDAVFHNAAKAGAWGSYDSYHQANVVGTQNVIEACRANGVPRLIYTSTPSVTHRATNPVEGLGADEVPYGDDLRAAYAATKAIAERAVLAANDAQLATVALRPRLIWGPGDNHLLPRLAARARAGRLRMVGDGGNLVDSTYIDNAAQAHFDAFEHLAVGAACAGRAYFISNGEPLPMRELLNRLLAAVDAPAVTCSLSFNTAYRIGAVCETLWPLLRLPGEVPLTRFLVEQLCTPHWYSMEPARRDFGYVPRISIEEGLQRLRSSSSNDIAITRKLAAA

SEQ ID NO: 17 - DNA, 1020 bp, Chloroflexus aggregans
atgttattcaagcacgtcatgatcgaagctgtttcctacgtactggcacctcatcgtatcacctctgcgtggatcgaagaccagatcgcagagacgatggagcgcctgcgtttcccgcgtggcaaactggaggctctgtctggcattcgtgagcgccgcttctgggacgaaggcaccctgccgtctactgttgctacgatggctgctgaacagctgctgcaacaagtatctgttgatcgtgaccgcattggcctgctgatcaacacctccgtatgtcaggattacctggagccgtccactgcatgttttgtgcaccgcaacctgggtctgtctccgcgtgcgatcaattttgatgtgcgtaacgcttgcctgggcttcctgaatggtatggcgatcgcaggtatgatgattgaggcgggcactatcgagtatgccctgatcgttgacggcgaaggctcccaggatgcggtgatggcgactatccgccgtctgcgtcgtccggagactaccaaacaggacctgcgtgacaacttcgcaacgctgactctgggctctggtggtgcggcgatgctgctgacccatgaatgtctgagccgttctggtcaccgtctgaacggcgtagttaccctggcagccacccagtataaccacctgtgtctgggccagcctgactacatgaaaactgatgctggcgccctgatgcacgcgggtgttgagctggcaaccgcgacctggcgcctggcgcaagaaaccctgccgaactggagcgatcgtcagatcgctctgtacgctccacatcaggttggcgcacgtcacatggcggctgtaacgaaggcgctgggcatcactccgagcaaactgttcctgaacttcccgaccctgggcaatattggtccggctgctctgccgattagcctggcccaggcggttgaagcgggtcgcctgcgtccgggtgaccacgtaggcctgctgggtatcggttccggtctgaattgctctatgatgtccgttacgtggtaa

SEQ ID NO: 18 - protein, 339 aa, Chloroflexus aggregans
MLFKHVMIEAVSYVLAPHRITSAWIEDQIAETMERLRFPRGKLEALSGIRERRFWDEGTLPSTVATMAAEQLLQQVSVDRDRIGLLINTSVCQDYLEPSTACFVHRNLGLSPRAINFDVRNACLGFLNGMAIAGMMIEAGTIEYALIVDGEGSQDAVMATIRRLRRPETTKQDLRDNFATLTLGSGGAAMLLTHECLSRSGHRLNGVVTLAATQYNHLCLGQPDYMKTDAGALMHAGVELATATWRLAQETLPNWSDRQIALYAPHQVGARHMAAVTKALGITPSKLFLNFPTLGNIGPAALPISLAQAVEAGRLRPGDHVGLLGIGSGLNCSMMSVTW

SEQ ID NO: 19 - DNA, 1695 bp, Chloroflexus aggregans
atgagagatctgtctcaacgtggtggtactgaagtatggccagcagttgctggtgctaatgttgctcgttatctgccgtggatggcacagcacatgccaacccagaccgcgattatcaccggcgtcggccgcgaccgttccggtaaagtgatttatcgccgtcagtccttcgctggcctgaacaccgcttctgatcgcctggcgtggggtctgaccgcctacggtttccgtccgggtatgcgtgtgctgctgatggtgccggcaggtgagccactgatccgcctgacgttcgctctgctgaaagcgggttgtgtgccgattctgattgacccagcgatgggccgtcgtaacctggctcagtgcattgcggaatctgcaccggaagctctggtcggcgtaccacgtgcgcacctgctgcgtctgatcttcccgcgtgcctgtgctaccattaaacacgctgtttctgtgggtcctgctctgccgggtgtggccgccctgcacgaactggaggttaccgtgaacgcaccgttcgcgctggcagaggttgctccgaccgatccggctgcgatcgttttcacctctggctccactggcaccccgaaaggcgtgctgtacacccacggtatgttcgaagctcagatccatgtactgcgtgagctgttcggtatcgaaccgggtgaaatcgaaatgccggcgttcccactgttcgcactgttcaacgtagctctgggtgttacctctgcgatcccgccgatcgacccgactcgtccggcacagtgcgatccagcggcggtagttgagtttatccgtgatctgggtgtaacttccaccttcggctcccctgcgatttgggaaaaagtgacggcgtattgcctggagcacggcatgcagctgccatctctgcgtcgtgttctgatggctggcgcccctgttccggcatacctgcacgagcgtctgcatcagatcctgattcctccggcggacagcttcaccccgtacggcgcgactgaggcgctgccggtcacctctattagcggtcgtgaggtactggcagcgcgctcccagtacccttctccgatggctggcacctgcgttggttatccggttccaaaggtaaaagtggctatcatcccgatctctgatgagccgatccaggcttggtctgatatccgtccgctgccaccgggtgtagttggtgaaatttgcgtttccggtccggcggttacgcgtgagtatgtcggccgtccacaggcaaccgtcctggcaaaaatcgcggatggtgaccaggtgtggcatcgcatgggcgatctgggttatttcgatgagtacggccgtctgtggttttatggccgcaaatcccagcgcgtaatcactgcgcaccgtaccctgttcactgagccggtggagctgctgttcaaccaacacccagcggtggcccgcagcgctctggtgggcgttggccctagcggcgcacagctgccagtggtagtggttgagcgtcgtccgcagatcacgattgcgcctacccagctgattgcggaactgcgtcagctggcagccaccactgagatgaccgcgtccatccatgattttctgatccatccggctttcccggttgacatccgtcacaacgctaagattttccgcgaacagctggctgtgtgggctgcaaaacaactgcgtgttccgggttaa

SEQ ID NO: 20 - protein, 564 aa, Chloroflexus aggregans
MRDLSQRGGTEVWPAVAGANVARYLPWMAQHMPTQTAIITGVGRDRSGKVIYRRQSFAGLNTASDRLAWGLTAYGFRPGMRVLLMVPAGEPLIRLTFALLKAGCVPILIDPAMGRRNLAQCIAESAPEALVGVPRAHLLRLIFPRACATIKHAVSVGPALPGVAALHELEVTVNAPFALAEVAPTDPAAIVFTSGSTGTPKGVLYTHGMFEAQIHVLRELFGIEPGEIEMPAFPLFALFNVALGVTSAIPPIDPTRPAQCDPAAVVEFIRDLGVTSTFGSPAIWEKVTAYCLEHGMQLPSLRRVLMAGAPVPAYLHERLHQILIPPADSFTPYGATEALPVTSISGREVLAARSQYPSPMAGTCVGYPVPKVKVAIIPISDEPIQAWSDIRPLPPGVVGEICVSGPAVTREYVGRPQATVLAKIADGDQVWHRMGDLGYFDEYGRLWFYGRKSQRVITAHRTLFTEPVELLFNQHPAVARSALVGVGPSGAQLPVVVVERRPQITIAPTQLIAELRQLAATTEMTASIHDFLIHPAFPVDIRHNAKIFREQLAVWAAKQLRVPG

SEQ ID NO: 21 - DNA, 990 bp, Chloroflexus aggregans
atgatcgctctggtaactggtggtaatggttttgttggccgttatctggtcgaacagctggttgcgcgtggtgaccacgtacgcgtagtgggccgtggcgagtatccggaactgcaggcactgggtgtggagactttctgtgccgacctggcaacgccagaatctgctccggttctggcgcgtgcaatgcgcggcgtgactgccgtattccacgtggctgctaaagcgggtctgtggggtcgttacgatgaattttaccgtgccaacgttagcgctacccagcgtgtgatgaaagcagctctgcgtgcgggcgtaccgaaattcatttacacttccactccatccgttgttatcggtatggacgacctgcacggtgttgacgagcagaccccgtacccaacccgttatctggcgccgtatccgcagactaaagcgctggccgagcgctacgtcctggcacagaccgagatcgcgactgtggcgctgcgcccgcacctgatttggggtccgcgtgacccgcacattctgccgcgtctgctgcgtcgtgcacgtcgtcgtatgctgttccaaatcggtgatggtactaacctggtggatgtgtgttatgtggaaaacgtcgccgaagcgcacatcctggctgcagctgcgctggacgatcgttctccgctgcgcggtcgcgcttacttcatcggccaggaacgcccggtgaacctgtggcaattcatcggcgaaattctgacgcacgctggttgtccgccggttcgcggcaaactgccggctaccgtagcctatcagctggcgaccgttctggagttcctgtacgccggcctgcgcctgccgggtgaaccgccgctgacccgtctgatggtgcacgagctgtctcactcccattggttctcccatgcggcagctgagcgtgattttggttacaccccgcgtatcagcatcgaggagggcctgcgtcgcactttcgctcgtcaggccatgtaa

SEQ ID NO: 22 - protein, 329 aa, Chloroflexus aggregans
MIALVTGGNGFVGRYLVEQLVARGDHVRVVGRGEYPELQALGVETFCADLATPESAPVLARAMRGVTAVFHVAAKAGLWGRYDEFYRANVSATQRVMKAALRAGVPKFIYTSTPSVVIGMDDLHGVDEQTPYPTRYLAPYPQTKALAERYVLAQTEIATVALRPHLIWGPRDPHILPRLLRRARRRMLFQIGDGTNLVDVCYVENVAEAHILAAAALDDRSPLRGRAYFIGQERPVNLWQFIGEILTHAGCPPVRGKLPATVAYQLATVLEFLYAGLRLPGEPPLTRLMVHELSHSHWFSHAAAERDFGYTPRISIEEGLRRTFARQAM

SEQ ID NO: 23 - DNA, 4864 bp, Artificial Sequence
  synthetic operon with OleA, OleB, OleC, and OleD
acatgttgttcaaaaatgtatctatcgctggtctggctcatgtggatgctccgcataccctgaccaccaaggagatcaacgaacgcctgcaaccgacgctggatcgcctgggtatccgtaccgacgtactgggcgacatcgctggtatccacgcacgtcgtctgtgggacaatggcgtactggcttctgatgctgcaactatggcaggccgtaaagcactggaggacgctggtattaacgcgactcaggtaggcctgctggtaaacacctccgtaagccgcgattacctggagccttccaccgcctccattgtgtctggcaacctgggcgtgtctgatgaatgcatgaccttcgatgttgctaacgcttgcctggcattcattaacggtatggatatcgcagcacgcatgattgaacgcggtgacatcgattacgccctggtagtagacggtgaaaccgcaaatctggtgtacgaaaagaccctggaacgtatgactgcaccggatgtgactgcagatgacttccgtaacgagctggctgctctgaccaccggttctggcgcggcagcgatggtgatggctcgctccgagctggtccctgatgcgccgcgttacaagggtggtgtgacccgtagcgccaccgaatggaaccaactgtgtctgggtaacctggaccgtatggttaccgacactcgtctgctgctgatcgaaggtatcaagctggctcagaaaacctttaccgccgctaaaattgctctgggttgggcagtggaagaactggaccagttcgtgattcaccaggtcagccaaccgcacactgcggcgttcatcaagaacttcggtatcgaccctaaaaaggtgatgaccattttcggtgagcacggcaacatcggcccagcttctgtaccgatcgttctgtctaaactgaaacagctgggcaaactgaaaaagggcgaccgcatcgcgctgctgggcatcggtagcggcctgaactgtagcatggctgaggttgtgtggtaacctgcaggacaaactggagaacttaagatgtctcaactgcctggttatcctgctcatccgcaacgttttgaagtgcgtccaggtttgagcatgaattatctggatgagggtccgcgcgacggcgaggtggttgttatggttcacggtaatcctagctggtcgtactactggcgcaccctggtggcaggcctgtccgatacctatcgctgtattgttccggatcatattggtatgggtctgagcgataaaccggacgactcgcgttacgagtatacgttgcagagccgcgtggacgatctggacgcattgctgaaacacctgggcatcaccggtccggtcaccctggcggttcacgactggggtggtatgattggtttcggttgggcgctgtcccatcatgaccaagtcaagcgcctggtggtgctgaataccgcggctttcccaatgccggcagcgaagaagatgccgtggcaaattgctctgggccgccattggaaaattggtgaatggattattcgtacctttaacgctttttcgagcggtgcgtcctggctgggtgtcgaacgcaagatgccagcggacgttcgtcgtgcttacgtgtctccgtacaatagctgggctaatcgcattagcactattcgttttatgcaggatattcctctgagcccggcagacaaagcgtggtccttgctggaacatgcgggtaaggcgttgccgtcttttgcggaccgtccggcattcctgggctggggcctgcgtgactttgttttcgaccaccactttctgaaaggcttccaagcggcgctgccgcaggctcaggtccatgcgtttgaggatgcaggtcactatgttctggaggataaacacgaggttctggtgccagagattcgtgcgttcctggataaaaacccgatctaggctagcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaattcccctctagaaataattttgtttaactttaagaaggaggaattctatgaatcgtccgtgcaacattgcggcgcgtctgccggagttggcgcgtgagcgtccggaccagattgccattcgttgccctggccgtcgtggcgcaggcaacggtatggcagcgtacgacgtgaccctggactaccgccaattggacgcgcgctcggacgcgatggccgctggtctggctggctatggtattggccgcggtgtccgtaccgtcgtcatggtgcgcccgtccccggagttctttctgctgatgttcgcgttgtttaaattgggcgcggtcccggtcctggtggacccaggtattgataagcgcgcgttgaaacaatgcttggacgaggcgcagccggaagccttcatcggtatcccactggcgcatgttgcgcgtttggctctgcgctgggcacgtagcgcgacccgcctggtcactgtgggtcgccgtttgggttggggtggcaccacgttggcggcgctggagcgtgcgggtgcgaacggcggtgccatgctggcagcgaccgacggcgaagatatggccgctatcttgttcaccagcggctcgaccggcgtgccaaaaggtgttgtttaccgccatcgtcacttcgttggccaaatccaactgctgggcagcgcctttggtatggaggcaggcggcgttgacttgccgaccttcccacctttcgcactgttcgatccggcgctgggcctgacttcggttatcccggatatggaccctacgcgccctgctcaggcagatccggcacgtctgcacgacgcgattcaacgtttcggcgtgacgcaattgtttggctcccctgcgctgatgcgcgtgctggctcgccacggtcgtcctctgccgacggtcacccgcgtgacctccgccggcgccccggtgccgccggacgtggtggctacgatccgctccctgttgccggcggatgcgcagttttggaccccgtatggtgccacggagtgcctgccggtggccgtggtggaaggccgtgagttggaacgtacccgtgcggcgaccgaggccggtgcgggcacctgcgtgggttccgtcgtggagccgaatgaagttcgtatcattggtattgatgacggtccactggcggattggagccaggcgcgtgttctggcgaccggtgaggtgggcgaaatcaccgtcgctggcccaacggctacggacagctactttaaccgtccgcaagcaaccgcggcggctaagattcgtgaaactctggcagacggctctactcgcgtggttcatcgtatgggtgacgtgggttacttcgatgcgcagggccgcttgtggttttgtggccgtaagacccatcgcgttgagactgcgcgtggtccgttgtataccgagcaagtcgagccggtgttcaataccgtcccaggtgtggcccgcacggcgctggttggcgttggtccggcgggtgctcaagtcccggtgttgtgcgtggagctgcaacgcggccaaagcgacagcccggctctgcaagaggcgctgcgtgctcacgcagcggcgcgtgcgccggaggcgggtctgcaacacttcctggtgcatccggcgttccccgtcgatatccgtcacaacgccaagatcggccgcgagaagctcgccgtctgggccagcgccgaactggagaagcgcgcatgaaaatcttggttaccggcggtggtggtttcctgggtcaggcattgtgtcgcggtctggttgagcgcggtcatcaagtgctggcttttaatcgttcgcactatccggaactgcaagcgatgggcgtgggtcaaatccgcggcgacttggcggacgcgcaagcggtcctgcacgccgtggcaggcgttgatgcggtgttccataatggtgcgaaagcgggtgcgtggggtagctatgactcgtatcatcaagcgaacgttgtgggcacggacaatgtcatcgccgcgtgtcgcgcgcacggcatttcgcgcttggtttacaccagcaccccgagcgtgacccaccgcgccacccatccggttgaaggcctgggtgcagatgaggttccttacggtgaggacttccaggcgccgtatgctgcgaccaaggcgatcgcggagcaacgcgttctggcggcgaatgacgctacgctggcaaccgttgcgctgcgtccacgtctgatctggggcccaggtgaccagcaactggtgccgcgtctggccgaacgcgcacgtcagggtcgtttgcgtttggttggcgacggcaacaataaggttgacaccacctacattgacaatgcggcattggcgcattttctggctctggacgcgctggcaccgggtgcggcatgtgccggccgtgcttacttcatctccaatggtgaaccactgccgatgcgcgaactggttaacaaactgctggctgcggtgggtgcgccgaccgtcgataaggcgatcagcttcaaaacggcctatcgcatcggtgcagtgtgtgagcgtctgtggccgctgctgcgtttgcgcggtgagccgccgctgacccgtttcttggctgaacagctgtgcacgccgcattggtacagcatggagccggcacgccgcgattttggttacgtcccgcaggtgagcattgaagaaggcctgcgtcgcttgaaggccagctccgctgcgtgaaagcggatcctcgagctcagatctcctaggttcgaagctt

SEQ ID NO: 24 - DNA, 5903 bp, Artificial Sequence
  pCL1920pTrc
cactataccaattgagatgggctagtcaatgataattactagtccttttcctttgagttgtgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcgtcggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggatccgagctcgagatctgcagctggtaccatatgggaattcgaagcttgggcccgaacaaaaactcatctcagaagaggatctgaatagcgccgtcgaccatcatcatcatcatcattgagtttaaacggtctccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgacgcctgatgcggtattttctccttacgcatctgtgcggtatttcacaccgcatatggtgcactctcagtacaatctgctctgatgccgcatagttaagccagccccgacacccgccaacacccgctgacgagcttagtaaagccctcgctagattttaatgcggatgttgcgattacttcgccaactattgcgataacaagaaaaagccagcctttcatgatatatctcccaatttgtgtagggcttattatgcacgcttaaaaataataaaagcagacttgacctgatagtttggctgtgagcaattatgtgcttagtgcatctaacgcttgagttaagccgcgccgcgaagcggcgtcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgccgttaccaccgctgcgttcggtcaaggttctggaccagttgcgtgagcgcatacgctacttgcattacagcttacgaaccgaacaggcttatgtccactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccagcttctgtatggaacgggcatgcggatcagtgagggtttgcaactgcgggtcaaggatctggatttcgatcacggcacgatcatcgtgcgggagggcaagggctccaaggatcgggccttgatgttacccgagagcttggcacccagcctgcgcgagcaggggaattaattcccacgggttttgctgcccgcaaacgggctgttctggtgttgctagtttgttatcagaatcgcagatccggcttcagccggtttgccggctgaaagcgctatttcttccagaattgccatgattttttccccacgggaggcgtcactggctcccgtgttgtcggcagctttgattcgataagcagcatcgcctgtttcaggctgtctatgtgtgactgttgagctgtaacaagttgtctcaggtgttcaatttcatgttctagttgctttgttttactggtttcacctgttctattaggtgttacatgctgttcatctgttacattgtcgatctgttcatggtgaacagctttgaatgcaccaaaaactcgtaaaagctctgatgtatctatcttttttacaccgttttcatctgtgcatatggacagttttccctttgatatgtaacggtgaacagttgttctacttttgtttgttagtcttgatgcttcactgatagatacaagagccataagaacctcagatccttccgtatttagccagtatgttctctagtgtggttcgttgtttttgcgtgagccatgagaacgaaccattgagatcatacttactttgcatgtcactcaaaaattttgcctcaaaactggtgagctgaatttttgcagttaaagcatcgtgtagtgtttttcttagtccgttatgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaat

SEQ ID NO: 25 - DNA, 552 bp, Escherichia coli
atggcggacacgttattgattctgggtgatagcctgagcgccgggtatcgaatgtctgccagcgcggcctggcctgccttgttgaatgataagtggcagagtaaaacgtcggtagttaatgccagcatcagcggcgacacctcgcaacaaggactggcgcgccttccggctctgctgaaacagcatcagccgcgttgggtgctggttgaactgggcggcaatgacggtttgcgtggttttcagccacagcaaaccgagcaaacgctgcgccagattttgcaggatgtcaaagccgccaacgctgaaccattgttaatgcaaatacgtctgcctgcaaactatggtcgccgttataatgaagcctttagcgccatttaccccaaactcgccaaagagtttgatgttccgctgctgcccttttttatggaagaggtctacctcaagccacaatggatgcaggatgacggtattcatcccaaccgcgacgcccagccgtttattgccgactggatggcgaagcagttgcagcctttagtaaatcatgactcataa

SEQ ID NO: 26 - DNA, 975 bp, Cinnamomum camphora
atgctcccagattggagtatgttatttgctgttatcacgactatattctcagcggccgagaaacagtggacaaatttggaatggaagcctaaacccaacccgccacaacttctggacgatcattttggacctcacggcctcgtcttccgcagaacctttgcaattcgatcctacgaggtagggccggaccgttcgacgagcatcgtggctgttatgaatcatctgcaggaagcggccttaaaccacgcaaaatctgtcggaattctgggcgatggtttcggcaccactttggaaatgagtaagcgcgatcttatctgggtagtgaaacggacacatgttgctgtcgagcgttatcccgcgtggggtgacacggtggaagtagagtgttgggttggggcctcaggaaataacggccgcagacacgattttctggtgcgagactgcaaaaccggtgaaatactcactcgttgtacatccttatcggtcatgatgaatacccgcacgcggcgtctgagcaagattccggaagaggttcgcggcgaaatcggtccagcattcattgataacgtagcggtgaaagacgaggaaataaaaaagcctcagaaattgaatgattctaccgctgattacatccaagggggacttactccgcgttggaacgacctggatattaatcagcatgtcaacaatatcaaatatgttgactggattttagaaacagtgcccgatagtatatttgagtcacaccatatctccagctttacgattgaataccgcagagagtgcacaatggattcggtactgcaatctctcactacagtcagtggcggttcaagcgaagccgggctggtttgtgaacacttgcttcagctggagggcggttccgaagtgttacgagcaaagacggaatggcggccgaaactgaccgactcgttccgtggaatatctgtaatcccagcggagagtagcgtttaa

SEQ ID NO: 27 - DNA, 987 bp, Cuphea hookeriana
atgctccccgattggtcccgcctgctgacagctatcaccacggtgtttgttaagtcgaaacggccggacatgcatgatagaaaaagcaagcgaccagacatgttagtcgattctttcggattggagagtactgtacaagatggccttgtgtttcgtcagtcattctccatacgcagctatgaaattggtacagaccgtaccgcgtcgatcgagacgctgatgaaccacctccaggaaacctctctgaatcattgcaaaagtactggcattttactggatggttttgggcgcacattggaaatgtgtaaacgggaccttatctgggttgtcataaagatgcaaattaaagtgaaccgttaccctgcctggggagatacggtagagatcaatacccgcttttcaagactgggcaaaattggtatgggccgagactggctcataagcgattgcaacactggtgaaatcttagttcgtgcaacatccgcttatgcgatgatgaatcagaagacccgccggctgtcgaaattgccgtacgaggtgcaccaagaaattgtcccacttttcgttgattctccggtaatcgaagacagtgatctgaaagtgcataagtttaaagtcaaaacgggggacagcattcagaagggattaacccccggctggaacgatctggatgttaatcagcacgtgtcaaacgtaaaatatataggttggattctggagtccatgcctactgaagtcctggagacacaagaattgtgttcgcttgccctggaataccgtcgcgagtgcgggcgtgactctgttttagaaagcgtgacggcaatggacccgagtaaagtaggcgttcgctcacagtatcaacatctgctcagattggaggacggtaccgcgattgtgaatggagctactgaatggcgaccaaagaacgccggcgcaaatggtgcgatatccacagggaaaacgagcaacggcaattcggtctcttaa

SEQ ID NO: 28 - DNA, 975 bp, Umbellularia californica
atgctccctgattggagtatgttatttgctgttatcacgactatattctcagcggccgagaaacaatggacaaatttggaatggaaacccaagccgaaacttccacagctgctcgacgatcattttggactgcacggcttagtcttcagacgaacctttgcaattcgttcctacgaggtagggcctgaccgctcgacgagcatcctggctgtgatgaaccacatgcaagaagcgaccttgaatcacgccaaatctgttggaattcttggcgatggtttcggcactacactggaaatgagtaagcgggatctcatgtgggtcgtacgtcgcacgcatgtggcagttgagagatatccgacctggggtgacactgtcgaagtggagtgttggatcggggcttcaggaaacaatggcatgcgacgtgattttttagtacgcgactgcaaaacaggtgaaatactgacccggtgtacgtccttgtcggttcttatgaacacccgtactcgccgtctgagcacaattcccgatgaagtgcgcggcgagatcggtccggcgttcattgacaatgtcgccgttaaagatgatgaaataaagaaattacagaaactgaacgactctacggcagattacatccaggggggactcaccccaagatggaatgacctggatgtaaaccaacacgtgaataacttgaagtatgtcgcgtgggtttttgagactgtgcctgatagtatttttgaatcacatcacatctccagcttcacacttgaataccgacgggagtgcacgcgtgactcggtactgcgctctttaaccactgtcagtggcggttcaagcgaagctgggctggtttgtgatcatctcttgcagctggagggcggttccgaagtgcttcgtgcccgcacggaatggcggccgaaattaaccgactcgtttcgtggaatttctgtaatacccgcagagccgcgcgtttaa

SEQ ID NO: 29 - DNA, 28 bp, Artificial Sequence
  LB118
gatacatatgctcttcaagaatgtctcg

SEQ ID NO: 30 - DNA, 32 bp, Artificial Sequence
  LB119
tcagctcgagccagaccacttcagccatcgag

SEQ ID NO: 31 - DNA, 30 bp, Artificial Sequence
  LB155
gatacatatgaaccgaccctgcaatattgc

SEQ ID NO: 32 - DNA, 40 bp, Artificial Sequence
  LB159
tcagctcgagtcatgcgcgcttctccagttcggcgctggc

SEQ ID NO: 33 - DNA, 33 bp, Artificial Sequence
  LB157
gatacatatgaagatcctggtcaccggtggtgg

SEQ ID NO: 34 - DNA, 34 bp, Artificial Sequence
  LB158
tcagctcgagctatgcggcagatgaagccttcag

SEQ ID NO: 35 - DNA, 29 bp, Artificial Sequence
  LB151
gatacatatgtcccagcttcccggttacc

SEQ ID NO: 36 - DNA, 32 bp, Artificial Sequence
  LB152
tcagctcgagtcagatcgggttcttgtccagg

SEQ ID NO: 37 - DNA, 30 bp, Artificial Sequence
  LF305
ggatacatgttattcaaaaatgtatctatc

SEQ ID NO: 38 - DNA, 29 bp, Artificial Sequence
  LF306
ctcgagaagcttaccacacaacctcagcc

SEQ ID NO: 39 - DNA, 32 bp, Artificial Sequence
  LF307
ggatacatgttatttcagaatgtttctatcgc

SEQ ID NO: 40 - DNA, 35 bp, Artificial Sequence
  LF308
ctcgagaagcttaccaaaccacttcggccatgctg

SEQ ID NO: 41 - DNA, 31 bp, Artificial Sequence
  LF313
ggatacatgttattcaagcacgtcatgatcg

SEQ ID NO: 42 - DNA, 33 bp, Artificial Sequence
  LF314
ctcgagaagcttaccacgtaacggacatcatag

SEQ ID NO: 43 - DNA, 37 bp, Artificial Sequence
  LB217
caatgggcccaaaacaatgctcttcaagaatgtctcg

SEQ ID NO: 44 - DNA, 35 bp, Artificial Sequence
  LF304
tcatctcgagttaccagaccacttcagccatcgag

SEQ ID NO: 45 - DNA, 31 bp, Artificial Sequence
  LB189
gatcacatgttattcaagaatgtctcgatcg

SEQ ID NO: 46 - DNA, 29 bp, Artificial Sequence
  fadD_F
catgccatggtgaagaaggtttggcttaa

SEQ ID NO: 47 - DNA, 27 bp, Artificial Sequence
  fadD_R
cccaagctttcaggctttattgtccac

SEQ ID NO: 48 - DNA, 69 bp, Artificial Sequence
  LB284
tttttaaagaaaaagaaacagcggctggtccgctgtttctgcattcttacggatgcatatggcggccgc

SEQ ID NO: 49 - DNA, 125 bp, Artificial Sequence
  LB285
aaccttcttcaattcttcacctctaaaatgcgtgttcgtcgtcatcgcaattgaatctattataattgttatccgctcacaaagcaaataaattttttatgatttgtatcgataagctggatcca

SEQ ID NO: 50 - DNA, 24 bp, Artificial Sequence
  TesA_F
catatggcggacacgttattgatt

SEQ ID NO: 51 - DNA, 29 bp, Artificial Sequence
  TesA_R
cctaggttatgagtcatgatttactaaag

SEQ ID NO: 52 - DNA, 41 bp, Artificial Sequence
  CcFatB_F
tctagagtctcgagacatatgctcccagattggagtatgtt

SEQ ID NO: 53 - DNA, 38 bp, Artificial Sequence
  CcFatB_R
tctagacgctctaagcttcctaggttaaacgctactct

SEQ ID NO: 54 - DNA, 38 bp, Artificial Sequence
  ChFatB2_F
tctagagtctcgagacatatgctccccgattggtcccg

SEQ ID NO: 55 - DNA, 39 bp, Artificial Sequence
  ChFatB2_R
tctagacgctctaagcttcctaggttaagagaccgaatt

SEQ ID NO: 56 - DNA, 42 bp, Artificial Sequence
  UcFatB1_F
tctagagtctcgagacatatgctccctgattggagtatgtta

SEQ ID NO: 57 - DNA, 35 bp, Artificial Sequence
  UcFatB1_R
tctagacgctctaagcttcctaggttaaacgcgcg

SEQ ID NO: 58 - DNA, 50 bp, Artificial Sequence
  LB200
gtcagcggtgactttgttaccagacgaagagcatcgaggttagcgccaag

SEQ ID NO: 59 - DNA, 50 bp, Artificial Sequence
  LB201
cttggcgctaacctcgatgctcttcgtctggtaacaaagtcaccgctgac

SEQ ID NO: 60 - DNA, 31 bp, Artificial Sequence
  LB202
gctctagaggtcaaccgcatccgcaacatcc

SEQ ID NO: 61 - DNA, 25 bp, Artificial Sequence
  LB203
cttcacctcgcgcctgaacatgaac

SEQ ID NO: 62 - DNA, 34 bp, Artificial Sequence
  LB204
tgacaagcttagcgcggcctggaagcccttcagg

SEQ ID NO: 63 - DNA, 24 bp, Artificial Sequence
  LB205
aaggccagcccgcagtgcgacaag

SEQ ID NO: 64 - protein, 13 aa, Artificial Sequence
  OleA Motif 1
  MISC_FEATURE (1)..(1): Xaa can be L or F
  misc_feature (2)..(3): Xaa can be any naturally occurring amino acid
  MISC_FEATURE (4)..(4): Xaa can be I, V, L, or M
  MISC_FEATURE (5)..(5): Xaa can be A, T, S, or V
  MISC_FEATURE (7)..(7): Xaa can be I or V
  misc_feature (8)..(8): Xaa can be any naturally occurring amino acid
  MISC_FEATURE (9)..(9): Xaa can be E, A, H, or S
  misc_feature (12)..(12): Xaa can be any naturally occurring amino acid
XXXXXGXXXRRXW

SEQ ID NO: 65 - protein, 13 aa, Artificial Sequence
  OleA Motif 2
  MISC_FEATURE (1)..(1): Xaa can be T, A, or C
  MISC_FEATURE (2)..(2): Xaa can be S, G, or T
  misc_feature (4)..(4): Xaa can be any naturally occurring amino acid
  MISC_FEATURE (5)..(5): Xaa can be R or Q
  misc_feature (6)..(8): Xaa can be any naturally occurring amino acid
  MISC_FEATURE (11)..(11): Xaa can be S or A
  MISC_FEATURE (12)..(12): Xaa can be T or V
XXVXXXXXEPXXA

SEQ ID NO: 66 - protein, 8 aa, Artificial Sequence
  OleA Motif 3
  MISC_FEATURE (2)..(2): Xaa can be V, I, or L
  misc_feature (3)..(3): Xaa can be any naturally occurring amino acid
  MISC_FEATURE (8)..(8): Xaa can be A or G
DXXNACLX

SEQ ID NO: 67 - protein, 6 aa, Artificial Sequence
  OleA Motif 4
  MISC_FEATURE (1)..(1): Xaa can be L or M
  misc_feature (3)..(3): Xaa can be any naturally occurring amino acid
  MISC_FEATURE (5)..(5): Xaa can be S, C, or A
XTXGXG

SEQ ID NO: 68 - protein, 12 aa, Artificial Sequence
  OleA Motif 5
  misc_feature (2)..(2): Xaa can be any naturally occurring amino acid
  MISC_FEATURE (4)..(4): Xaa can be D, S, or N
  misc_feature (5)..(11): Xaa can be any naturally occurring amino acid
MXTXXXXXXXXG

SEQ ID NO: 69 - protein, 25 aa, Artificial Sequence
  OleA Motif 6
  MISC_FEATURE (1)..(1): Xaa can be L or F
  misc_feature (2)..(3): Xaa can be any naturally occurring amino acid
  MISC_FEATURE (5)..(5): Xaa can be D or E
  misc_feature (6)..(9): Xaa can be any naturally occurring amino acid
  MISC_FEATURE (10)..(10): Xaa can be L or M
  MISC_FEATURE (12)..(12): Xaa can be I, V, or M
  MISC_FEATURE (16)..(16): Xaa can be L or I
  MISC_FEATURE (18)..(18): Xaa can be C, A, T, or S
  misc_feature (19)..(19): Xaa can be any naturally occurring amino acid
  MISC_FEATURE (20)..(20): Xaa can be M, A, or V
  misc_feature (21)..(24): Xaa can be any naturally occurring amino acid
XXXGXXXXXXGXGSGXNXXXXXXXW

SEQ ID NO: 70 - protein, 22 aa, Artificial Sequence
  OleD Motif 1
  MISC_FEATURE (1)..(1): Xaa can be I, L, V, or A
  MISC_FEATURE (2)..(2): Xaa can be L, F, or V
  MISC_FEATURE (6)..(6): Xaa can be G, A, or C
  MISC_FEATURE (7)..(7): Xaa can be G, S, or N
  MISC_FEATURE (9)..(9): Xaa can be F, L, or M
  MISC_FEATURE (10)..(10): Xaa can be L or V
  misc_feature (12)..(13): Xaa can be any naturally occurring amino acid
  MISC_FEATURE (14)..(14): Xaa can be L, V, I, or T
  MISC_FEATURE (14)..(14): Xaa can be C, V, or A
  misc_feature (15)..(17): Xaa can be any naturally occurring amino acid
  misc_feature (19)..(21): Xaa can be any naturally occurring amino acid
XXVTGXXGXXGXXXXXXLXXXG

SEQ ID NO: 71 - protein, 10 aa, Artificial Sequence
  OleD Motif 2
  MISC_FEATURE (2)..(2): Xaa can be N, V, T, or L
  MISC_FEATURE (3)..(3): Xaa can be A or G
  MISC_FEATURE (4)..(4): Xaa can be A or S
  MISC_FEATURE (5)..(5): Xaa can be K, L, V, I, Q, or R
  MISC_FEATURE (6)..(6): Xaa can be V, A, P, or I
  MISC_FEATURE (7)..(7): Xaa can be G, S, or D
  MISC_FEATURE (8)..(8): Xaa can be A, V, L, I, or M
  misc_feature (9)..(9): Xaa can be any naturally occurring amino acid
HXXXXXXXXG

SEQ ID NO: 72 - protein, 19 aa, Artificial Sequence
  OleC Motif 1
  misc_feature (2)..(3): Xaa can be any naturally occurring amino acid
  MISC_FEATURE (4)..(4): Xaa can be D or E
  MISC_FEATURE (5)..(5): Xaa can be L or M
  MISC_FEATURE (6)..(6): Xaa can be P, A, C, or S
  MISC_FEATURE (7)..(7): Xaa can be T, A, or G
  MISC_FEATURE (10)..(10): Xaa can be L or P
  MISC_FEATURE (12)..(12): Xaa can be A, S, or G
  misc_feature (15)..(16): Xaa can be any naturally occurring amino acid
  MISC_FEATURE (18)..(18): Xaa can be L or M
GXXXXXXFPXFXLFXXAXG

SEQ ID NO: 73 - protein, 25 aa, Artificial Sequence
  OleC Motif 2
  MISC_FEATURE (6)..(6): Xaa can be V or L
  MISC_FEATURE (7)..(7): Xaa can be G or A
  misc_feature (8)..(9): Xaa can be any naturally occurring amino acid
  misc_feature (11)..(15): Xaa can be any naturally occurring amino acid
  MISC_FEATURE (17)..(17): Xaa can be F or M
  MISC_FEATURE (18)..(18): Xaa can be C or Y
  misc_feature (22)..(22): Xaa can be any naturally occurring amino acid
  MISC_FEATURE (23)..(23): Xaa can be H or Q
  MISC_FEATURE (24)..(24): Xaa can be R or I
HRMGDXXXXDXXXXXWXXGRKXXXV

SEQ ID NO: 74 - protein, 25 aa, Artificial Sequence
  OleC Motif 3
  misc_feature (2)..(2): Xaa can be any naturally occurring amino acid
  misc_feature (4)..(5): Xaa can be any naturally occurring amino acid
  MISC_FEATURE (8)..(8): Xaa can be V or M
  MISC_FEATURE (10)..(10): Xaa can be I or V
  MISC_FEATURE (14)..(14): Xaa can be A or S
  MISC_FEATURE (17)..(17): Xaa can be G or F
  misc_feature (20)..(20): Xaa can be any naturally occurring amino acid
  misc_feature (23)..(23): Xaa can be any naturally occurring amino acid
LXHXXFPXDXRHNXKIXREXLAXWA

SEQ ID NO: 75 - DNA, 1851 bp, Artificial Sequence
  OleA deletion
agcttagcgcggcctggaagcccttcaggaagtgatggtcgaacacgaagtcgcgcaggccccagccgaggaaggccgggcggtcggcgaacgacggcagcgccttgccggcacgctccagcagcgaccaggccttgtcggccggcgacagcggaatgtcctgcatgaagcggatggtgctgatgcggttggcgtagctgttgtacggcgacacgtacgcgcggcgcacgtcggccggcatcttccgctccacgcccagccacgaggcaccggacgagaaggcgttgaatgtgcggatgatccactcgccgatcttccagtggcggcccagcgcgatctgccacggcatcttcttcgccgccggcatcgggaacgcagcggtattgagcaccaccaggcgcttgacctggtcgtggtgcgacagcgcccagccgaaaccgatcatgccgccccagtcgtgcaccgccagggtcaccgggccggttatgcccagatgcttgagcagcgcatcgaggtcgtcaacgcgcgactgcagcgtgtactcgtagcggctgtcatcgggcttgtccgacaggcccatgccgatgtggtccggcacgatgcagcggtacgtgtccgacaggccggcgaccagcgtgcgccagtaatagctccacgacgggttgccgtgcaccatcaccaccacttcgccatcgcgcgggccttcgtcgagatagttcatcgacaggccggggcggacctcgaagcgctgcgggtgggcggggtaaccgggaagctgggacatcggatcgcacctgtagaaagggccggtagaaccggcccttggacacttggaagatcatcgctgtccgtcgcgagcgattggcgaggcaatcgcgcagcaggtcagcggtgactttgttaccagacgaagagcatcgaggttagcgccaaggctcaggcaaaagggggcgctattctataactcccggggccttcaccgcatctttacgaattcaggcttggccgtatggtgaagcattcagcgcggcgggcactggaatgcggcaaagcgctggctgccatcggccggtgcggcagcggcctgcacggcattggcaccggcgctcggagcctcgttgcgggccagggtttccagctcttcctgcacgcgcagcgggttgcggttgtagaaaccaaccttgctcttcacggtcaccaccacctcgcccttggcgatgcaaccggccggaaccgggcctgccggcagcacgcgggtcgtcttgcccgccggttcgatcggcacccaggtacaggcggtaacggtgagcagcagggaggaaagcagcagaacgcgcatgggcagatcctggaagggtatggggggattctgcctgaaccgtctgaatcgggggtagcccgggggtggggtcagatcccccggtagcgccgggccatgcccggcgagcgcacagcgcggcattgctggccgccaaaaaaaccgccgggcatggcccggcgctatcaccggaggcctgcccgccgaggcgggcaggcgcatcccttatttcttgaccgggttgccttcggcgtcgatcaccgtcacctcacccagattcagcgcacgcaccgccgcttcagtctgcttgaggtcacccaccaccacccaggtcagtgcctgcggcttgatctcggcggcggcctgctgcacctgcgccggagtcattgcctcgatctcggccttgcgacgcagcacgtagtcatccggacgcttgaactgcacgatcgagccgatgcttgcggccaccgcgctggcggtctcgtaggcaccaggcaggctcagggtctggatgttgcggatgcggttgacct

SEQ ID NO: 76 - DNA, 28 bp, Artificial Sequence
  LF302
atatgacgtcggcatccgcttacagaca

SEQ ID NO: 77 - DNA, 32 bp, Artificial Sequence
  LF303
aattcttaagtcaggagagcgttcaccgacaa

SEQ ID NO: 78 - DNA, 10713 bp, Artificial Sequence
  pCL1920pTrcOleABpTrcLOleCD
cactataccaattgagatgggctagtcaatgataattactagtccttttcctttgagttgtgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcgtcggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatgttgttcaaaaatgtatctatcgctggtctggctcatgtggatgctccgcataccctgaccaccaaggagatcaacgaacgcctgcaaccgacgctggatcgcctgggtatccgtaccgacgtactgggcgacatcgctggtatccacgcacgtcgtctgtgggacaatggcgtactggcttctgatgctgcaactatggcaggccgtaaagcactggaggacgctggtattaacgcgactcaggtaggcctgctggtaaacacctccgtaagccgcgattacctggagccttccaccgcctccattgtgtctggcaacctgggcgtgtctgatgaatgcatgaccttcgatgttgctaacgcttgcctggcattcattaacggtatggatatcgcagcacgcatgattgaacgcggtgacatcgattacgccctggtagtagacggtgaaaccgcaaatctggtgtacgaaaagaccctggaacgtatgactgcaccggatgtgactgcagatgacttccgtaacgagctggctgctctgaccaccggttctggcgcggcagcgatggtgatggctcgctccgagctggtccctgatgcgccgcgttacaagggtggtgtgacccgtagcgccaccgaatggaaccaactgtgtctgggtaacctggaccgtatggttaccgacactcgtctgctgctgatcgaaggtatcaagctggctcagaaaacctttaccgccgctaaaattgctctgggttgggcagtggaagaactggaccagttcgtgattcaccaggtcagccaaccgcacactgcggcgttcatcaagaacttcggtatcgaccctaaaaaggtgatgaccattttcggtgagcacggcaacatcggcccagcttctgtaccgatcgttctgtctaaactgaaacagctgggcaaactgaaaaagggcgaccgcatcgcgctgctgggcatcggtagcggcctgaactgtagcatggctgaggttgtgtggtaacctgcaggacaaactggagaacttaagatgtctcaactgcctggttatcctgctcatccgcaacgttttgaagtgcgtccaggtttgagcatgaattatctggatgagggtccgcgcgacggcgaggtggttgttatggttcacggtaatcctagctggtcgtactactggcgcaccctggtggcaggcctgtccgatacctatcgctgtattgttccggatcatattggtatgggtctgagcgataaaccggacgactcgcgttacgagtatacgttgcagagccgcgtggacgatctggacgcattgctgaaacacctgggcatcaccggtccggtcaccctggcggttcacgactggggtggtatgattggtttcggttgggcgctgtcccatcatgaccaagtcaagcgcctggtggtgctgaataccgcggctttcccaatgccggcagcgaagaagatgccgtggcaaattgctctgggccgccattggaaaattggtgaatggattattcgtacctttaacgctttttcgagcggtgcgtcctggctgggtgtcgaacgcaagatgccagcggacgttcgtcgtgcttacgtgtctccgtacaatagctgggctaatcgcattagcactattcgttttatgcaggatattcctctgagcccggcagacaaagcgtggtccttgctggaacatgcgggtaaggcgttgccgtcttttgcggaccgtccggcattcctgggctggggcctgcgtgactttgttttcgaccaccactttctgaaaggcttccaagcggcgctgccgcaggctcaggtccatgcgtttgaggatgcaggtcactatgttctggaggataaacacgaggttctggtgccagagattcgtgcgttcctggataaaaacccgatctaggctagcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaattcccctctagaaataattttgtttaactttaagaaggaggaattctatgaatcgtccgtgcaacattgcggcgcgtctgccggagttggcgcgtgagcgtccggaccagattgccattcgttgccctggccgtcgtggcgcaggcaacggtatggcagcgtacgacgtgaccctggactaccgccaattggacgcgcgctcggacgcgatggccgctggtctggctggctatggtattggccgcggtgtccgtaccgtcgtcatggtgcgcccgtccccggagttctttctgctgatgttcgcgttgtttaaattgggcgcggtcccggtcctggtggacccaggtattgataagcgcgcgttgaaacaatgcttggacgaggcgcagccggaagccttcatcggtatcccactggcgcatgttgcgcgtttggctctgcgctgggcacgtagcgcgacccgcctggtcactgtgggtcgccgtttgggttggggtggcaccacgttggcggcgctggagcgtgcgggtgcgaacggcggtgccatgctggcagcgaccgacggcgaagatatggccgctatcttgttcaccagcggctcgaccggcgtgccaaaaggtgttgtttaccgccatcgtcacttcgttggccaaatccaactgctgggcagcgcctttggtatggaggcaggcggcgttgacttgccgaccttcccacctttcgcactgttcgatccggcgctgggcctgacttcggttatcccggatatggaccctacgcgccctgctcaggcagatccggcacgtctgcacgacgcgattcaacgtttcggcgtgacgcaattgtttggctcccctgcgctgatgcgcgtgctggctcgccacggtcgtcctctgccgacggtcacccgcgtgacctccgccggcgccccggtgccgccggacgtggtggctacgatccgctccctgttgccggcggatgcgcagttttggaccccgtatggtgccacggagtgcctgccggtggccgtggtggaaggccgtgagttggaacgtacccgtgcggcgaccgaggccggtgcgggcacctgcgtgggttccgtcgtggagccgaatgaagttcgtatcattggtattgatgacggtccactggcggattggagccaggcgcgtgttctggcgaccggtgaggtgggcgaaatcaccgtcgctggcccaacggctacggacagctactttaaccgtccgcaagcaaccgcggcggctaagattcgtgaaactctggcagacggctctactcgcgtggttcatcgtatgggtgacgtgggttacttcgatgcgcagggccgcttgtggttttgtggccgtaagacccatcgcgttgagactgcgcgtggtccgttgtataccgagcaagtcgagccggtgttcaataccgtcccaggtgtggcccgcacggcgctggttggcgttggtccggcgggtgctcaagtcccggtgttgtgcgtggagctgcaacgcggccaaagcgacagcccggctctgcaagaggcgctgcgtgctcacgcagcggcgcgtgcgccggaggcgggtctgcaacacttcctggtgcatccggcgttccccgtcgatatccgtcacaacgccaagatcggccgcgagaagctcgccgtctgggccagcgccgaactggagaagcgcgcatgaaaatcttggttaccggcggtggtggtttcctgggtcaggcattgtgtcgcggtctggttgagcgcggtcatcaagtgctggcttttaatcgttcgcactatccggaactgcaagcgatgggcgtgggtcaaatccgcggcgacttggcggacgcgcaagcggtcctgcacgccgtggcaggcgttgatgcggtgttccataatggtgcgaaagcgggtgcgtggggtagctatgactcgtatcatcaagcgaacgttgtgggcacggacaatgtcatcgccgcgtgtcgcgcgcacggcatttcgcgcttggtttacaccagcaccccgagcgtgacccaccgcgccacccatccggttgaaggcctgggtgcagatgaggttccttacggtgaggacttccaggcgccgtatgctgcgaccaaggcgatcgcggagcaacgcgttctggcggcgaatgacgctacgctggcaaccgttgcgctgcgtccacgtctgatctggggcccaggtgaccagcaactggtgccgcgtctggccgaacgcgcacgtcagggtcgtttgcgtttggttggcgacggcaacaataaggttgacaccacctacattgacaatgcggcattggcgcattttctggctctggacgcgctggcaccgggtgcggcatgtgccggccgtgcttacttcatctccaatggtgaaccactgccgatgcgcgaactggttaacaaactgctggctgcggtgggtgcgccgaccgtcgataaggcgatcagcttcaaaacggcctatcgcatcggtgcagtgtgtgagcgtctgtggccgctgctgcgtttgcgcggtgagccgccgctgacccgtttcttggctgaacagctgtgcacgccgcattggtacagcatggagccggcacgccgcgattttggttacgtcccgcaggtgagcattgaagaaggcctgcgtcgcttgaaggccagctccgctgcgtgaaagcggatcctcgagctcagatctcctaggttcgaagcttgggcccgaacaaaaactcatctcagaagaggatctgaatagcgccgtcgaccatcatcatcatcatcattgagtttaaacggtctccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgacgcctgatgcggtattttctccttacgcatctgtgcggtatttcacaccgcatatggtgcactctcagtacaatctgctctgatgccgcatagttaagccagccccgacacccgccaacacccgctgacgagcttagtaaagccctcgctagattttaatgcggatgttgcgattacttcgccaactattgcgataacaagaaaaagccagcctttcatgatatatctcccaatttgtgtagggcttattatgcacgcttaaaaataataaaagcagacttgacctgatagtttggctgtgagcaattatgtgcttagtgcatctaacgcttgagttaagccgcgccgcgaagcggcgtcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgccgttaccaccgctgcgttcggtcaaggttctggaccagttgcgtgagcgcatacgctacttgcattacagcttacgaaccgaacaggcttatgtccactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccagcttctgtatggaacgggcatgcggatcagtgagggtttgcaactgcgggtcaaggatctggatttcgatcacggcacgatcatcgtgcgggagggcaagggctccaaggatcgggccttgatgttacccgagagcttggcacccagcctgcgcgagcaggggaattaattcccacgggttttgctgcccgcaaacgggctgttctggtgttgctagtttgttatcagaatcgcagatccggcttcagccggtttgccggctgaaagcgctatttcttccagaattgccatgattttttccccacgggaggcgtcactggctcccgtgttgtcggcagctttgattcgataagcagcatcgcctgtttcaggctgtctatgtgtgactgttgagctgtaacaagttgtctcaggtgttcaatttcatgttctagttgctttgttttactggtttcacctgttctattaggtgttacatgctgttcatctgttacattgtcgatctgttcatggtgaacagctttgaatgcaccaaaaactcgtaaaagctctgatgtatctatcttttttacaccgttttcatctgtgcatatggacagttttccctttgatatgtaacggtgaacagttgttctacttttgtttgttagtcttgatgcttcactgatagatacaagagccataagaacctcagatccttccgtatttagccagtatgttctctagtgtggttcgttgtttttgcgtgagccatgagaacgaaccattgagatcatacttactttgcatgtcactcaaaaattttgcctcaaaactggtgagctgaatttttgcagttaaagcatcgtgtagtgtttttcttagtccgttatgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaat

SEQ ID NO: 79 - DNA, 23 bp, Artificial Sequence
  LB270
aacaactaattcagacatacatc

SEQ ID NO: 80 - DNA, 36 bp, Artificial Sequence
  LB271
cttccgctagctgcctgacgccagaagcattggtgc

SEQ ID NO: 81 - DNA, 45 bp, Artificial Sequence
  LB272
ataggatcctaaggaggaataaaccatgttgttcaaaaatgtatc

SEQ ID NO: 82 - DNA, 37 bp, Artificial Sequence
  LB275
ttaagatctagatcgggtttttatccaggaacgcacg

SEQ ID NO: 83 - DNA, 69 bp, Artificial Sequence; identical to SEQ ID NO: 48
  LB284

SEQ ID NO: 84 - DNA, 125 bp, Artificial Sequence; identical to SEQ ID NO: 49
  LB285

SEQ ID NO: 85 - DNA, 25 bp, Artificial Sequence
  LB223
gctgaacatgtctactgaaggtgct

SEQ ID NO: 86 - DNA, 27 bp, Artificial Sequence
  LB224
tgcaagcttacgcagacgtgcttctgc

SEQ ID NO: 87 - DNA, 1761 bp, Plesiocystis pacifica
atgtctactgaaggtgctggtgaactgcctgctactgttgctgatatgctgccgcgtatggcagcgagccagccggacgctactgcgatttacttcccgacgaaacgccgtgatgcagatggccaactggtctacactcaggtaagctaccgtgagctggacgaacgctccgatcgtatcgctgccggtctgcacgccgtcggcgtcgcccgtggccatcgtgctgtgctgatggttccaccgagcccggagctgtttgctctgacctttgccatgtttaaagcaggtgttgtcccggttatgattgacccgggcctgggtatcaaaggtctgcagagctgtattgcccgtgcagaaccgaccgcctttattggcattccgaaagcccacgtggcgcgtgttctgttcggctggggccgtgcgaccattcgtcagcgcgtgcatgttggtggtatgggcctgggcggtactaagctggaacgcgtggaagcactgggtgctgagcgtctggctgctggcgatcgtcctgaaccaacccgtggcgaagagattgctgccatcctgtttacctctggctctaccggtcctccgaagggtgttgtttaccgtcaccgtactttcgttgcccaggttgagtccctgcgtgaaatgttcggcattgaaccgggtgaggtgaacctgccgactttcccgctgttcgctctgttcgatccggctctgggcatgactacggtactgccggacatggattctaccaagccggctcaggtggacccgcgtaacatcctggagccggtgcagcgtttcggtgttaccaccatgtttggcagcccggctctgctgaacaccgtaggccgttacggcgaggcgcatggcgcaaagctgcctagcctgcgtcgcgttattgcggcgggtgcgccgctgcctggcccgacgatggcccgttggcacggtatggtcccggctacggcggatctgttcccaccgtacggcgcaactgagtctctgccggttgcgtgcctgccgtgtcgttccattcgtggtgaaacctggccgcacactgaagttggtgcaggtgtttgcgtaggcttcccagtgccgtccatcgaggttcgtatcatccagatttccgatgagccggttccggagtggagcccggcactggaactggagcgtggcgaggtcggcgaaattactgtttgcggtccgatggttaccgaatcctattttaacgatgaggcaaacactgcaaaagcgaaaatcgtagaacagtctgatgacggtcgtcgcatttggcaccgtatgggtgacgttggctggcgtgacgagcaaggtcgcatctggttctgcggtcgtaaatcccaccgtgttgttctggatgcggccgagccaggcgcctctaccctgtttactgttcctgcggagaaagttttcgagacgcatccggcggtgtatcgctgtgcgctggttggtccgcagcgtggtggcgccgttgaggcagcgctgtgcgtggagctggaacctgatcatccggcgcgtaaggacgctcaggcgtggtctactgtggaagcggaactgcgtgaactggctaaacaccaggctgagtatgctgaaggtacgctggcaccggcgctgggtctggaccgcgttcgccattacctgcgttacgacgacgcgaaaggcttcccggttgatatccgccacaatgcaaaaatcggtcgtggcaaactgcgtgcgtgggcagaagcacgtctgcgttaa

SEQ ID NO: 88 - protein, 586 aa, Plesiocystis pacifica
MSTEGAGELPATVADMLPRMAASQPDATAIYFPTKRRDADGQLVYTQVSYRELDERSDRIAAGLHAVGVARGHRAVLMVPPSPELFALTFAMFKAGVVPVMIDPGLGIKGLQSCIARAEPTAFIGIPKAHVARVLFGWGRATIRQRVHVGGMGLGGTKLERVEALGAERLAAGDRPEPTRGEEIAAILFTSGSTGPPKGVVYRHRTFVAQVESLREMFGIEPGEVNLPTFPLFALFDPALGMTTVLPDMDSTKPAQVDPRNILEPVQRFGVTTMFGSPALLNTVGRYGEAHGAKLPSLRRVIAAGAPLPGPTMARWHGMVPATADLFPPYGATESLPVACLPCRSIRGETWPHTEVGAGVCVGFPVPSIEVRIIQISDEPVPEWSPALELERGEVGEITVCGPMVTESYFNDEANTAKAKIVEQSDDGRRIWHRMGDVGWRDEQGRIWFCGRKSHRVVLDAAEPGASTLFTVPAEKVFETHPAVYRCALVGPQRGGAVEAALCVELEPDHPARKDAQAWSTVEAELRELAKHQAEYAEGTLAPALGLDRVRHYLRYDDAKGFPVDIRHNAKIGRGKLRAWAEARLR

SEQ ID NO: 89 - DNA, 4423 bp, Artificial Sequence
  pLoxCat2
aaattgtaaacgttaatattttgttaaaattcgcgttaaatttttgttaaatcagctcattttttaaccaataggccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccactacgtgaaccatcacccaaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtactatggttgctttgacgtatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttaaggtgcacggcccacgtggccactagtacttctcgaggtcgacggtatcgataagctggatccataacttcgtataatgtatgctatacgaagttatctagagtctgcatgcctgcaggtccgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggactctagataacttcgtataatgtatgctatacgaagttatgcggccgccatatgcatcctaggcctattaatattccggagtatacgtagccggctaacgttctagcatgcgaaatttaaagcgctgatatcgatcgcgcgcagatctgtcatgatgatcattgcaattggatccatatatagggcccggggttataattacctcaggtcgacgtcccatggccattcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccata

SEQ ID NO: 90 - DNA, 6329 bp, Artificial Sequence
  plasmid pKD46
catcgatttattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggaattcgagctctaaggaggttataaaaaatggatattaatactgaaactgagatcaagcaaaagcattcactaaccccctttcctgttttcctaatcagcccggcatttcgcgggcgatattttcacagctatttcaggagttcagccatgaacgcttattacattcaggatcgtcttgaggctcagagctgggcgcgtcactaccagcagctcgcccgtgaagagaaagaggcagaactggcagacgacatggaaaaaggcctgccccagcacctgtttgaatcgctatgcatcgatcatttgcaacgccacggggccagcaaaaaatccattacccgtgcgtttgatgacgatgttgagtttcaggagcgcatggcagaacacatccggtacatggttgaaaccattgctcaccaccaggttgatattgattcagaggtataaaacgaatgagtactgcactcgcaacgctggctgggaagctggctgaacgtgtcggcatggattctgtcgacccacaggaactgatcaccactcttcgccagacggcatttaaaggtgatgccagcgatgcgcagttcatcgcattactgatcgttgccaaccagtacggccttaatccgtggacgaaagaaatttacgcctttcctgataagcagaatggcatcgttccggtggtgggcgttgatggctggtcccgcatcatcaatgaaaaccagcagtttgatggcatggactttgagcaggacaatgaatcctgtacatgccggatttaccgcaaggaccgtaatcatccgatctgcgttaccgaatggatggatgaatgccgccgcgaaccattcaaaactcgcgaaggcagagaaatcacggggccgtggcagtcgcatcccaaacggatgttacgtcataaagccatgattcagtgtgcccgtctggccttcggatttgctggtatctatgacaaggatgaagccgagcgcattgtcgaaaatactgcatacactgcagaacgtcagccggaacgcgacatcactccggttaacgatgaaaccatgcaggagattaacactctgctgatcgccctggataaaacatgggatgacgacttattgccgctctgttcccagatatttcgccgcgacattcgtgcatcgtcagaactgacacaggccgaagcagtaaaagctcttggattcctgaaacagaaagccgcagagcagaaggtggcagcatgacaccggacattatcctgcagcgtaccgggatcgatgtgagagctgtcgaacagggggatgatgcgtggcacaaattacggctcggcgtcatcaccgcttcagaagttcacaacgtgatagcaaaaccccgctccggaaagaagtggcctgacatgaaaatgtcctacttccacaccctgcttgctgaggtttgcaccggtgtggctccggaagttaacgctaaagcactggcctggggaaaacagtacgagaacgacgccagaaccctgtttgaattcacttccggcgtgaatgttactgaatccccgatcatctatcgcgacgaaagtatgcgtaccgcctgctctcccgatggtttatgcagtgacggcaacggccttgaactgaaatgcccgtttacctcccgggatttcatgaagttccggctcggtggtttcgaggccataaagtcagcttacatggcccaggtgcagtacagcatgtgggtgacgcgaaaaaatgcctggtactttgccaactatgacccgcgtatgaagcgtgaaggcctgcattatgtcgtgattgagcgggatgaaaagtacatggcgagttttgacgagatcgtgccggagttcatcgaaaaaatggacgaggcactggctgaaattggttttgtatttggggagcaatggcgatgacgcatcctcacgataatatccgggtaggcgcaatcactttcgtctactccgttacaaagcgaggctgggtatttcccggcctttctgttatccgaaatccactgaaagcacagcggctggctgaggagataaataataaacgaggggctgtatgcacaaagcatcttctgttgagttaagaacgagtatcgagatggcacatagccttgctcaaattggaatcaggtttgtgccaataccagtagaaacagacgaagaatccatgggtatggacagttttccctttgatatgtaacggtgaacagttgttctacttttgtttgttagtcttgatgcttcactgatagatacaagagccataagaacctcagatccttccgtatttagccagtatgttctctagtgtggttcgttgtttttgcgtgagccatgagaacgaaccattgagatcatacttactttgcatgtcactcaaaaattttgcctcaaaactggtgagctgaatttttgcagttaaagcatcgtgtagtgtttttcttagtccgttacgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaatcactataccaattgagatgggctagtcaatgataattactagtccttttcctttgagttgtgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcttaagtagcaccctcgcaagctcggttgcggccgcaatcgggcaaatcgctgaatattccttttgtctccgaccatcaggcacctgagtcgctgtctttttcgtgacattcagttcgctgcgctcacggctctggcagtgaatgggggtaaatggcactacaggcgccttttatggattcatgcaaggaaactacccataatacaagaaaagcccgtcacgggcttctcagggcgttttatggcgggtctgctatgtggtgctatctgactttttgctgttcagcagttcctgccctctgattttccagtctgaccacttcggattatcccgtgacaggtcattcagactggctaatgcacccagtaaggcagcggtatcatcaacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 91 - protein, 15 aa, Artificial Sequence
  OleB Motif 1
  MISC_FEATURE (1)..(1): Xaa can be V, I, L, M, or F
  MISC_FEATURE (2)..(2): Xaa can be V or L
  MISC_FEATURE (3)..(3): Xaa can be M, L, F, or C
  MISC_FEATURE (4)..(4): Xaa can be V, L, or I
  MISC_FEATURE (9)..(9): Xaa can be S or T
  MISC_FEATURE (11)..(11): Xaa can be S, C, G, or T
  MISC_FEATURE (12)..(12): Xaa can be F, Y, or L
  MISC_FEATURE (13)..(13): Xaa can be Y, F, L, A, or B
  MISC_FEATURE (14)..(14): Xaa can be W or Y
XXXXHGNPXWXXXXR

SEQ ID NO: 92 - protein, 17 aa, Artificial Sequence
  OleB Motif 2
  MISC_FEATURE (1)..(1): Xaa can be R or Q
  MISC_FEATURE (2)..(2): Xaa can be C, V, I, L, or T
  MISC_FEATURE (3)..(3): Xaa can be I, V, or L
  MISC_FEATURE (4)..(4): Xaa can be V, A, or C
  MISC_FEATURE (5)..(5): Xaa can be P, V, M, or L
  MISC_FEATURE (7)..(7): Xaa can be H, N, or L
  MISC_FEATURE (8)..(8): Xaa can be I, M, L, P, or V
  MISC_FEATURE (10)..(10): Xaa can be M, C, or F
  MISC_FEATURE (12)..(12): Xaa can be L, F, R, Y, K, or T
  MISC_FEATURE (14)..(14): Xaa can be D, E, R, or S
  MISC_FEATURE (15)..(15): Xaa can be K or R
  MISC_FEATURE (16)..(16): Xaa can be P or L
  MISC_FEATURE (17)..(17): Xaa can be D, G, S, A, or R
XXXXXDXXGXGXSXXXX

SEQ ID NO: 93 - protein, 16 aa, Artificial Sequence
  OleB Motif 3
  MISC_FEATURE (1)..(1): Xaa can be T, I, H, D, or S
  MISC_FEATURE (2)..(2): Xaa can be L or F
  MISC_FEATURE (3)..(3): Xaa can be A, V, I, M, F, or C
  MISC_FEATURE (4)..(4): Xaa can be V, L, or A
  MISC_FEATURE (10)..(10): Xaa can be M, A, F, or P
  MISC_FEATURE (11)..(11): Xaa can be I or L
  MISC_FEATURE (13)..(13): Xaa can be F, M, T, L, V, or C
  MISC_FEATURE (14)..(14): Xaa can be G, A, or S
  MISC_FEATURE (15)..(15): Xaa can be W, Y, F, A, L, M, or C
  MISC_FEATURE (16)..(16): Xaa can be A or M
XXXXHDWGGXXGXXXX

SEQ ID NO: 94 - protein, 10 aa, Artificial Sequence
  OleB Motif 4
  MISC_FEATURE (1)..(1): Xaa can be R, K, Q, or N
  MISC_FEATURE (2)..(2): Xaa can be L, I, V, C, or F
  MISC_FEATURE (3)..(3): Xaa can be V, G, or I
  MISC_FEATURE (4)..(4): Xaa can be I, V, L, M, C, or A
  MISC_FEATURE (5)..(5): Xaa can be L, T, C, M, or F
  MISC_FEATURE (8)..(8): Xaa can be A, G, V, or S
  MISC_FEATURE (9)..(9): Xaa can be A, V, or G
XXXXXNTXXF

SEQ ID NO: 95 - protein, 14 aa, Artificial Sequence
  OleB Motif 5
  MISC_FEATURE (1)..(1): Xaa can be N, D, H, K, or E
  MISC_FEATURE (3)..(3): Xaa can be I, V, or R
  MISC_FEATURE (4)..(4): Xaa can be S or A
  MISC_FEATURE (5)..(5): Xaa can be T, I, or V
  misc_feature (6)..(7): Xaa can be any naturally occurring amino acid
  MISC_FEATURE (8)..(8): Xaa can be F or A
  MISC_FEATURE (9)..(9): Xaa can be V, I, or M
  MISC_FEATURE (10)..(10): Xaa can be Q, G, H, L, K, or R
  MISC_FEATURE (11)..(11): Xaa can be D, A, or T
  MISC_FEATURE (13)..(13): Xaa can be P or A
  MISC_FEATURE (14)..(14): Xaa can be L, C, or R
XRXXXXXXXXXIXX

SEQ ID NO: 96 - protein, 13 aa, Artificial Sequence
  OleB Motif 6
  MISC_FEATURE (1)..(1): Xaa can be W or F
  misc_feature (3)..(3): Xaa can be any naturally occurring amino acid
  MISC_FEATURE (4)..(4): Xaa can be R, Q, K, Y, or H
  MISC_FEATURE (6)..(6): Xaa can be F, I, W, or P
  MISC_FEATURE (7)..(7): Xaa can be V or C
  MISC_FEATURE (9)..(9): Xaa can be D, N, T, or R
  misc_feature (10)..(11): Xaa can be any naturally occurring amino acid
  MISC_FEATURE (12)..(12): Xaa can be F, Y, C, or L
  MISC_FEATURE (13)..(13): Xaa can be L, F, or Y
XGXXDXXFXXXXX

SEQ ID NO: 97 - protein, 7 aa, Artificial Sequence
  OleB Motif 7
  MISC_FEATURE (1)..(1): Xaa can be G or N
  MISC_FEATURE (4)..(4): Xaa can be V, I, or L
  MISC_FEATURE (5)..(5): Xaa can be L, V, or I
XHYXXED

SEQ ID NO: 98 - protein, 11 aa, Artificial Sequence
  OleA Motif
  misc_feature (2)..(2): Xaa can be any naturally occurring amino acid
  MISC_FEATURE (3)..(3): Xaa can be R or Q
  MISC_FEATURE (4)..(4): Xaa can be D, P, A, or R
  MISC_FEATURE (5)..(5): Xaa can be Y, H, T, or N
  MISC_FEATURE (9)..(9): Xaa can be S or A
  MISC_FEATURE (10)..(10): Xaa can be T or V
VXXXXLEPXXA

SEQ ID NO: 99 - protein, 13 aa, Artificial Sequence
  OleA Motif
  MISC_FEATURE (3)..(3): Xaa can be V, I, or L
  misc_feature (4)..(4): Xaa can be any naturally occurring amino acid
  misc_feature (9)..(9): Xaa can be any naturally occurring amino acid
  MISC_FEATURE (10)..(10): Xaa can be F or W
  misc_feature (11)..(11): Xaa can be any naturally occurring amino acid
FDXXNACLXXXNG

SEQ ID NO: 100 - protein, 10 aa, Artificial Sequence
  OleA Motif
  MISC_FEATURE (2)..(2): Xaa can be D, E, or R
  MISC_FEATURE (5)..(5): Xaa can be L or V
  MISC_FEATURE (6)..(6): Xaa can be I or V
  MISC_FEATURE (7)..(7): Xaa can be V or L
  misc_feature (8)..(8): Xaa can be any naturally occurring amino acid
  MISC_FEATURE (9)..(9): Xaa can be G or A
IXYAXXXXXE

SEQ ID NO: 101 - protein, 13 aa, Artificial Sequence
  OleA Motif
  misc_feature (2)..(4): Xaa can be any naturally occurring amino acid
  MISC_FEATURE (7)..(7): Xaa can be I or V
  MISC_FEATURE (10)..(10): Xaa can be A or I
  misc_feature (11)..(12): Xaa can be any naturally occurring amino acid
FXXXGNXGPXXXP

SEQ ID NO: 102 - protein, 11 aa, Artificial Sequence
  OleA Motif
  MISC_FEATURE (1)..(1): Xaa can be L or M
  MISC_FEATURE (3)..(3): Xaa can be I or V
  misc_feature (9)..(9): Xaa can be any naturally occurring amino acid
  MISC_FEATURE (10)..(10): Xaa can be S, A, or G
XGXGSGLNXXM

SEQ ID NO: 103 - protein, 16 aa, Artificial Sequence
  OleC Motif
  MISC_FEATURE (3)..(3): Xaa can be I or V
  misc_feature (4)..(4): Xaa can be any naturally occurring amino acid
  misc_feature (12)..(12): Xaa can be any naturally occurring amino acid
  MISC_FEATURE (13)..(13): Xaa can be P or A
AAXXFTSGSTGXXKGV

SEQ ID NO: 104 - protein, 22 aa, Artificial Sequence
  OleC Motif
  misc_feature (2)..(3): Xaa can be any naturally occurring amino acid
  misc_feature (7)..(9): Xaa can be any naturally occurring amino acid
  misc_feature (13)..(13): Xaa can be any naturally occurring amino acid
  MISC_FEATURE (14)..(14): Xaa can be T or V
  MISC_FEATURE (15)..(15): Xaa can be S or T
  misc_feature (16)..(17): Xaa can be any naturally occurring amino acid
  misc_feature (19)..(20): Xaa can be any naturally occurring amino acid
  MISC_FEATURE (22)..(22): Xaa can be P or V
FXXFALXXXALGXXXXXPXXDX

SEQ ID NO: 105 - protein, 11 aa, Artificial Sequence
  OleC Motif
  MISC_FEATURE (1)..(1): Xaa can be T or P
  misc_feature (5)..(5): Xaa can be any naturally occurring amino acid
  misc_feature (8)..(8): Xaa can be any naturally occurring amino acid
XPYGXTEXLPV

SEQ ID NO: 106 - protein, 21 aa, Artificial Sequence
  OleC Motif
  misc_feature (3)..(3): Xaa can be any naturally occurring amino acid
  misc_feature (6)..(6): Xaa can be any naturally occurring amino acid
  MISC_FEATURE (8)..(8): Xaa can be Y, H, M, or W
  misc_feature (9)..(9): Xaa can be any naturally occurring amino acid
  misc_feature (11)..(12): Xaa can be any naturally occurring amino acid
  MISC_FEATURE (15)..(15): Xaa can be L or I
  MISC_FEATURE (17)..(17): Xaa can be V or F
  misc_feature (18)..(18): Xaa can be any naturally occurring amino acid
  MISC_FEATURE (21)..(21): Xaa can be K or L
HRXGDXGXXDXXGRXWXXGRX

SEQ ID NO: 107 - protein, 14 aa, Artificial Sequence
  OleC Motif
  MISC_FEATURE (2)..(2): Xaa can be L or I
  MISC_FEATURE (3)..(3): Xaa can be V or T
  MISC_FEATURE (5)..(5): Xaa can be V, P, or I
  MISC_FEATURE (6)..(6): Xaa can be G or Q
  misc_feature (7)..(8): Xaa can be any naturally occurring amino acid
  MISC_FEATURE (10)..(10): Xaa can be A, Q, or T
  MISC_FEATURE (11)..(11): Xaa can be Q or V
  misc_feature (12)..(12): Xaa can be any naturally occurring amino acid
  MISC_FEATURE (13)..(13): Xaa can be P, A, or V
  MISC_FEATURE (14)..(14): Xaa can be V or A
AXXGXXXXGXXXXX

SEQ ID NO: 108 - protein, 23 aa, Artificial Sequence
  OleC Motif
  MISC_FEATURE (2)..(2): Xaa can be V or T
  misc_feature (11)..(11): Xaa can be any naturally occurring amino acid
  misc_feature (13)..(14): Xaa can be any naturally occurring amino acid
  MISC_FEATURE (16)..(16): Xaa can be A or R
  misc_feature (17)..(17): Xaa can be any naturally occurring amino acid
  misc_feature (20)..(22): Xaa can be any naturally occurring amino acid
PXDIRHNAKIXRXXLXXWAXXXL

SEQ ID NO: 109 - protein, 17 aa, Artificial Sequence
  OleD Motif
  MISC_FEATURE (5)..(5): Xaa can be A or G
  MISC_FEATURE (6)..(6): Xaa can be G, N, or S
  MISC_FEATURE (8)..(8): Xaa can be F, L, or M
  MISC_FEATURE (9)..(9): Xaa can be L or V
  MISC_FEATURE (11)..(11): Xaa can be Q, R, A, or G
  misc_feature (12)..(12): Xaa can be any naturally occurring amino acid
  MISC_FEATURE (13)..(13): Xaa can be L, V, or T
  MISC_FEATURE (14)..(14): Xaa can be C, V, or A
  MISC_FEATURE (15)..(15): Xaa can be R or E
  misc_feature (16)..(16): Xaa can be any naturally occurring amino acid
LVTGXXGXXGXXXXXXL

SEQ ID NO: 110 - protein, 15 aa, Artificial Sequence
  OleD Motif
  MISC_FEATURE (1)..(1): Xaa can be V, I, or A
  misc_feature (2)..(2): Xaa can be any naturally occurring amino acid
  MISC_FEATURE (3)..(3): Xaa can be A, T, or G
  MISC_FEATURE (4)..(4): Xaa can be I or V
  misc_feature (5)..(5): Xaa can be any naturally occurring amino acid
  misc_feature (7)..(8): Xaa can be any naturally occurring amino acid
  MISC_FEATURE (11)..(11): Xaa can be A or V
  MISC_FEATURE (12)..(12): Xaa can be G or S
  misc_feature (13)..(14): Xaa can be any naturally occurring amino acid
XXXXXHXXAKXXXXG

SEQ ID NO: 111 - protein, 9 aa, Artificial Sequence
  OleD Motif
  MISC_FEATURE (1)..(1): Xaa can be Y, H, or M
  MISC_FEATURE (2)..(2): Xaa can be T or V
  MISC_FEATURE (4)..(4): Xaa can be T or S
  MISC_FEATURE (8)..(8): Xaa can be V, T, or A
  MISC_FEATURE (9)..(9): Xaa can be H or I
XXSXPSVXX

SEQ ID NO: 112 - protein, 15 aa, Artificial Sequence
  OleD Motif
  MISC_FEATURE (1)..(1): Xaa can be A or R
  MISC_FEATURE (2)..(2): Xaa can be T or V
  misc_feature (3)..(3): Xaa can be any naturally occurring amino acid
  MISC_FEATURE (4)..(4): Xaa can be A or V
  MISC_FEATURE (5)..(5): Xaa can be L or V
  MISC_FEATURE (8)..(8): Xaa can be R or H
  MISC_FEATURE (9)..(9): Xaa can be L or I
  misc_feature (10)..(10): Xaa can be any naturally occurring amino acid
  MISC_FEATURE (11)..(11): Xaa can be W or L
  MISC_FEATURE (14)..(14): Xaa can be G or R
XXXXXRPXXXXGPXD

SEQ ID NO: 113 - protein, 11 aa, Artificial Sequence
  OleD Motif
  MISC_FEATURE (2)..(2): Xaa can be R or E
  MISC_FEATURE (4)..(4): Xaa can be Y, L, F, or V
  MISC_FEATURE (5)..(5): Xaa can be F or V
  MISC_FEATURE (6)..(6): Xaa can be I or V
  misc_feature (7)..(7): Xaa can be any naturally occurring amino acid
  MISC_FEATURE (8)..(8): Xaa can be N or Q
  MISC_FEATURE (9)..(9): Xaa can be G or E
  misc_feature (10)..(10): Xaa can be any naturally occurring amino acid
GXAXXXXXXXP

SEQ ID NO: 114 - protein, 10 aa, Artificial Sequence
  OleD Motif
  MISC_FEATURE (1)..(1): Xaa can be G or D
  MISC_FEATURE (3)..(3): Xaa can be P or V
  MISC_FEATURE (5)..(5): Xaa can be L or M
  MISC_FEATURE (7)..(7): Xaa can be R or E
  MISC_FEATURE (8)..(8): Xaa can be F or L
  MISC_FEATURE (9)..(9): Xaa can be L or M
  MISC_FEATURE (10)..(10): Xaa can be A or B
XEXPXTXXXX

SEQ ID NO: 115 - protein, 11 aa, Artificial Sequence
  OleD Motif
  misc_feature (2)..(2): Xaa can be any naturally occurring amino acid
  MISC_FEATURE (3)..(3): Xaa can be I or V
  MISC_FEATURE (4)..(4): Xaa can be S or P
  MISC_FEATURE (5)..(5): Xaa can be I or L
  MISC_FEATURE (6)..(6): Xaa can be E or D
  MISC_FEATURE (9)..(9): Xaa can be L or F
  MISC_FEATURE (10)..(10): Xaa can be R, Q, H, A
PXXXXXEGXXR

SEQ ID NO: 116 - protein, 8 aa, Artificial Sequence
  OleA Motif
DYLEPSTA

SEQ ID NO: 117 - protein, 14 aa, Artificial Sequence
  OleA Motif
  misc_feature (4)..(4): Xaa can be any naturally occurring amino acid
  misc_feature (9)..(9): Xaa can be any naturally occurring amino acid
  misc_feature (11)..(11): Xaa can be any naturally occurring amino acid
FDVXNACLXFXNGM

SEQ ID NO: 118 - protein, 8 aa, Artificial Sequence
  OleA Motif
  MISC_FEATURE (4)..(4): Xaa can be I or V
YALXVDGE

SEQ ID NO: 119 - protein, 14 aa, Artificial Sequence
  OleA Motif
  misc_feature (2)..(4): Xaa can be any naturally occurring amino acid
  misc_feature (11)..(12): Xaa can be any naturally occurring amino acid
FXXXGNIGPAXXPI

SEQ ID NO: 120 - protein, 11 aa, Artificial Sequence
  OleA Motif
LGIGSGLNCSM

SEQ ID NO: 121 - protein, 21 aa, Artificial Sequence
  OleC Motif
  MISC_FEATURE (4)..(4): Xaa can be L or V
  MISC_FEATURE (12)..(12): Xaa can be V, T, or P
  MISC_FEATURE (17)..(17): Xaa can be V or L
  MISC_FEATURE (19)..(19): Xaa can be R or T
  MISC_FEATURE (21)..(21): Xaa can be R or G
AAIXFTSGSTGXPKGVXYXHX

SEQ ID NO: 122 - protein, 20 aa, Artificial Sequence
  OleC Motif
  MISC_FEATURE (2)..(2): Xaa can be A or T
  MISC_FEATURE (5)..(5): Xaa can be L or P
  MISC_FEATURE (10)..(10): Xaa can be N or D
  MISC_FEATURE (11)..(11): Xaa can be V or P
  MISC_FEATURE (15)..(15): Xaa can be L, M, or V
  MISC_FEATURE (17)..(17): Xaa can be S or T
  MISC_FEATURE (18)..(18): Xaa can be A or V
  MISC_FEATURE (19)..(19): Xaa can be I or L
PXFPXFALFXXALGXTXXXP

SEQ ID NO: 123 - protein, 11 aa, Artificial Sequence
  OleC motif
  MISC_FEATURE (1)..(1): Xaa can be T or P
  misc_feature (8)..(8): Xaa can be any naturally occurring amino acid
XPYGATEXLPV

SEQ ID NO: 124 - protein, 21 aa, Artificial Sequence
  OleC Motif
  misc_feature (6)..(6): Xaa can be any naturally occurring amino acid
  MISC_FEATURE (8)..(8): Xaa can be Y or W
  misc_feature (9)..(9): Xaa can be any naturally occurring amino acid
  misc_feature (11)..(12): Xaa can be any naturally occurring amino acid
  MISC_FEATURE (15)..(15): Xaa can be L or I
  MISC_FEATURE (18)..(18): Xaa can be C or Y
HRMGDXGXXDXXGRXWFXGRK

SEQ ID NO: 125 - protein, 14 aa, Artificial Sequence
  OleC Motif
  MISC_FEATURE (5)..(5): Xaa can be V or P
  MISC_FEATURE (6)..(6): Xaa can be G or Q
  misc_feature (7)..(8): Xaa can be any naturally occurring amino acid
  MISC_FEATURE (10)..(10): Xaa can be A or Q
  MISC_FEATURE (11)..(11): Xaa can be Q or V
  misc_feature (12)..(12): Xaa can be any naturally occurring amino acid
  MISC_FEATURE (13)..(13): Xaa can be P or A
  MISC_FEATURE (14)..(14): Xaa can be V or A
ALVGXXXXGXXXXX

SEQ ID NO: 126 - protein, 24 aa, Artificial Sequence
  OleC Motif
  MISC_FEATURE (12)..(12): Xaa can be G or F
  MISC_FEATURE (14)..(14): Xaa can be E or G
  misc_feature (15)..(15): Xaa can be any naturally occurring amino acid
  MISC_FEATURE (17)..(17): Xaa can be A or R
  MISC_FEATURE (18)..(18): Xaa can be V or A
  misc_feature (21)..(23): Xaa can be any naturally occurring amino acid
FPVDIRHNAKIXRXXLXXWAXXXL

SEQ ID NO: 127 - protein, 17 aa, Artificial Sequence
  OleD Motif
  MISC_FEATURE (6)..(6): Xaa can be G or N
  MISC_FEATURE (9)..(9): Xaa can be L or V
  misc_feature (11)..(12): Xaa can be any naturally occurring amino acid
  misc_feature (14)..(16): Xaa can be any naturally occurring amino acid
LVTGGXGFXGXXLXXXL

SEQ ID NO: 128 - protein, 26 aa, Artificial Sequence
  OleD Motif
  MISC_FEATURE (2)..(2): Xaa can be V or I
  MISC_FEATURE (3)..(3): Xaa can be D or T
  misc_feature (8)..(9): Xaa can be any naturally occurring amino acid
  misc_feature (14)..(14): Xaa can be any naturally occurring amino acid
  misc_feature (17)..(17): Xaa can be any naturally occurring amino acid
  misc_feature (20)..(23): Xaa can be any naturally occurring amino acid
GXXAVFHXXAKAGXWGXYDXXXXANV

SEQ ID NO: 129 - protein, 8 aa, Artificial Sequence
  OleD Motif
  MISC_FEATURE (8)..(8): Xaa can be V or T
YTSTPSVX

SEQ ID NO: 130 - protein, 15 aa, Artificial Sequence
  OleD Motif
  MISC_FEATURE (8)..(8): Xaa can be R or H
  MISC_FEATURE (14)..(14): Xaa can be G or R
ATVALRPXLIWGPXD

SEQ ID NO: 131 - protein, 11 aa, Artificial Sequence
  OleD Motif
  misc_feature (7)..(10): Xaa can be any naturally occurring amino acid
GRAYFIXXXXP

SEQ ID NO: 132 - protein, 11 aa, Artificial Sequence
  OleD Motif
  misc_feature (4)..(4): Xaa can be any naturally occurring amino acid
  misc_feature (7)..(7): Xaa can be any naturally occurring amino acid
LRLXGEXPLTR

SEQ ID NO: 133 - protein, 17 aa, Artificial Sequence
  OleD Motif
  misc_feature (6)..(6): Xaa can be any naturally occurring amino acid
  misc_feature (8)..(9): Xaa can be any naturally occurring amino acid
  MISC_FEATURE (16)..(16): Xaa can be R or Q
RDFGYXPXXSIEEGLXR

SEQ ID NO: 134 - DNA, 7689 bp, Artificial Sequence
  OP-122
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctgaattggagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttatttagaagtgtcaacaacgtatctaccaacgatttgacccttttccatcttttcgtaaatttctggcaaggtagacaagccgacaaccttgattggagacttgaccaaacctctggcgaagaattgttaattaagagctcagatcttatcgtcgtcatccttgtaatccatcgatactagtgcggccgccctttagtgagggttgaattcgaattttcaaaaattcttactttttttttggatggacgcaaagaagtttaataatcatattacatggcattaccaccatatacatatccatatacatatccatatctaatcttacttatatgttgtggaaatgtaaagagccccattatcttagcctaaaaaaaccttctctttggaactttcagtaatacgcttaactgctcattgctatattgaagtacggattagaagccgccgagcgggtgacagccctccgaaggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatgaacgaatcaaattaacaaccataggatgataatgcgattagttttttagccttatttctggggtaattaatcagcgaagcgatgatttttgatctattaacagatatataaatgcaaaaactgcataaccactttaactaatactttcaacattttcggtttgtattacttcttattcaaatgtaataaaagtatcaacaaaaaattgttaatatacctctatactttaacgtcaaggagaaaaaaccccggatccgtaatacgactcactatagggcccaaaacaatgctcttcaagaatgtctcgatcgccggcctggcacacgttgatgcgccgcatacgctgacgaccaaggaaatcaacgagcggctgcagccgacgttggatcgcctcggtatccgcaccgacgtgctcggcgatatcgccggcatccatgcccgccgcctgtgggacaacggcgtgcttgcgtccgatgccgccaccatggccggccgcaaggcgctggaagacgcgggcatcgatgcgacgcaggtcggcctgctggtcaacacctcggtcagccgcgactacctggagccgtccacggcctccatcgtgtcgggcaacctcggcgtcagcgacgagtgcatgaccttcgacgtcgccaatgcctgcctggccttcatcaacggcatggacatcgcggcgcgcatgatcgagcgcggcgacatcgactacgcgctggtggtggatggcgagaccgccaacctggtgtacgagaagaccctggagcgcatgaccgccccggacgtcaccgccgacgacttccgcaacgaactggcggcgctgaccaccggttcgggtgctgcggcgatggtgatggcgcgctcggagctggtgccggacgcgccgcgctacaagggcggtgtcacccgttcggccaccgagtggaaccagctgtgcctgggcaacctggaccggatggtcaccgacacccgcctgctgctgatcgaaggcatcaagctggcgcagaagaccttcagcgccgccaagatcgcactcggctgggctgtggaagaactggaccagttcgtgatccaccaggtcagccagccgcacaccgccgcgttcatcaagaacttcggcatcgacccgaagaaggtcatgaccatcttcggcgagcacggcaacatcggcccggcctcggtgccgatcgtgctgagcaagctcaagcagctgggcaagctgaagaagggcgatcgcatcgcgcttctgggcattggctcgggcctgaactgctcgatggctgaagtggtctggtaactcgagtaagcttggtaccgcggctagctaagatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaagatccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtc

SEQ ID NO: 135 - protein, 921 aa, Arthrobacter aurescens
MHGRGLRPERWNGGNRLVAANWPGVDPEWSRTLRVRSTSEVDAPGVLRRWHVLDNGAQLSRRGLTPIGTLLCVHGNPTWSYLWRTLVRAGSDPAHPWRVVAVDQLDMGYSERTGTFRRLADRINDLGDLTDALGLEGPVVTVGHDWGGVISSGWALEHPQQVTAVVLTNTAVHHPSDSPLPAALRLALHPAVHRWGTTTSDAFLRVTHSLANPPLPADVGKAFMAPYRGAARRTGVGNFVADIPADPSHPSFPALTRVAEGLRGLKVPALMLWGPTDPIFSDRYLKDLIARLPHADVHRFEGAGHLVGEDRDIATPVFDWLAVHGAKIGGDDSPVAAAPASRHLIQDTEEEKPAFRPLWDSLSELAAGPAKEDIAVAEMASDGSVSHSLSWQQLDRNILDMAEGLRESGVGHGTRVSLMVPPGTDLTVALYACLKLGAVVVVADAGLGTKGMSRAVKGATADFLIGIDKALAAASVLGWPGQRISVKDLPAARRRILGVETSLAALARNGATIRDARRLRNGDELPMDSVDPSAPAAVLFTSGSTGPAKGVLYTHRQLAAMRDTVAATFGIHSGSRLVAGFAPFALLGPALGAVSVTPAMDVTAPRTLTAGALADAVAAIEASVVFASPAALRNVIDTRGDLSRTGLIALENVELLLSAGAPVPEPLLAQVQQLMPGASLHTPYGMTEALPVTDISLEDIRAADADADAGTIAGAGNGVCVGKPVHGARVAVIPLAANGTAPGPNRVTDAGVTGEILISAPHVKEAYDRLWLTQRESASLAGWHRTGDVGHFDAAGRLWVEGRLSHVVTAPGAVVTPVGAEQSIERLDRVRMAAITGVGPSGTQAVVAVVETVPPVPKAGPADPQLAGHVRRAASQAGVEVNAVLVVPTQPTDIRHNAKIDRTRLARWASQVLAGGRPGKP

SEQ ID NO: 136 - protein, 890 aa, Clavibacter michiganensis
MSASAAVVPATVPVAGPDGQPLPGLDPAWSRVVRAGGNGWHLLDTGERLADTGAPVAGTILCVHGNPTWSYLWRRIAAESLARAERDPSRPAWRVVAVDQLDMGFSQRTGVTRTLPMRLDDLQALTDELGLTGSGATAPVVTLGHDWGGVVSLGWALRNRDVLAGVMALNTAVHQEEGVPIPWPLRLALATGIHDAATRGTPGFLATTLALAHPPLDPAVRRAFAAPYRGADRRAGIRGFVADIPVGPAHPSHATLTSIAEGLRDLDLPALFVWGPRDPIFSDVYLSDLLERLPHADVHRVEGAGHLVAEDHDYASAALDWLADRVAPGSAPAPAPAAPVASPPVRLLGALLEELRDSDDPVLVEMAPRGGGGPRTVSWRLLSRRVREIAAGLHARGLRAGDRVSLLVPPGADLTALLYACLRIGAVVVVADAGLGVKGLGRAVAGSRPDMVVGIPAGLALARALGWPGERISVTTLAPPVARALGVAASLPEIARDGRAQVLPPEPAADDDAAILFTSGSTGPAKGVVYTNRQLAALRDTLGSRFDVGVGTGLVAGFAPFALLGPALGATSVTPDMDVTRPRDLTASALAAAARAADATVVFASPAALANVVATADALSDADREALGRVRSLLSAGAPLSEALLARAAALVPDAEVHTPYGMTEGLLLTDVTLEGIRAAALRRDAGVCVGAPVDPVAIRISPLDADGAATGALTVEPGITGEIVAAAPHVHDRYDRLHVTDRAARRDSADGIRRHRTGDVGHLDATGALWIEGRLPHVITTADGVLTPVGPEQRAESAPGLGRAAAVGVGPAGVQQLVLVVETVPAARRVGLADPDLAAAVRAAVGGPVAAVIVVPVLPTDVRHNSKVDRARLGRWAAGILTGGRVSAP

SEQ ID NO: 137 - protein, 915 aa, Kineococcus radiotolerans
MSAGLPLPAVTPPADLPGFDPRWSRLVQAPDHAGVLRTWHVLDTAPDAGPDDVVGTLLCVHGNPTWSYLWRGLASAASAVQLGWRVVAVDQLEMGYSERTGTTRRLADRVEDLAGLVQALELSGEVVAVGHDWGGIVVSGWAAGELARGGGRRDAGRHASTGPASPLRVAGLVVANTAASWPADAAAPGVLKLALLPGVLPGVTSRSEVFLRTTLALPKPPLPAAVKAAYRGPYRSRGERAGIEAFVADVPVGAGHPSRPALDAVTEGVAALAAAGLPTFVAWGPRDPVFTEWFLRDWRARVPHADVHRFATASHLTPEDPQFAAAVLRWLDERVLHPVSPDTTAAAPAVPAPRMWAALEQRAADPATASSPAVVEMSPDGTSRRVAWGLLARRTDELAAGFTALGVRPGQRVSLLVPPGADLTATLYALLRIGAVAVVADAGLGVRGLSRAVTGAGVDWVVGVPKALAAARVLRWPGRRVAAGDVSDAALRALGVEATLLQVARTGAQRLAAGAEAPVEPAPGAEAAVLFTSGSTGPAKGVVYTHGQLAQLAQAMGATIRIGPGQPLVSAFAPFALFGPALGATCVVPAMDVTRPATLTAAALAEAVAAASATSVFLAPAAVVNVLATAGDLTPAQREALGGVSTLLSAGAPVPTPLLQRVRELMPLADPRTPYGATEVLPATDVGLSDVLAAGAGEGICVGRPVEGVVVAIAPLDADGRAGLDLVSTPGAVGEVVVGGEHVKDHYDQLWFTQAASVDVRPSPTLLGRVRPGRWHRTGDVGHLDAEGRVWVEGRLAHVVVTADEVVTPVGVEQRAESVPGIARAAFVGIGPRAARRFAVVAEVEADVVPGITRTTVADPELAEAVRAATGRNLVALLLVPALPTDVRHNSKIDRARVGAWAERVLAGERAGKLA

SEQ ID NO: 138 - protein, 880 aa, Clavibacter michiganensis
MAGPDGQPLPGLHPAWSRVVRAGGHGWHLLDTGERLAATGAPVAGTILCVHGNPTWSYLWRRIAAESLARAERDPSRPAWRVVAVDQLDMGFSERTGVARTLPTRLADLQALTDELGLSGSGATGPVVTLGHDWGGVVSLGWALRNRDVLAGVMALNTAVHQEEGVPIPWPLRLALATGIHDAATRGTPGFLATTLALAHPPLDPTVRRAFAAPYRGASRRAGIRGFVADIPVGPAHPSHATLTSIAEGLRDLDLPALFVWGPRDPIFSDVYLSDLLERLPHADVHRVEGAGHLVTEDHDYASAALDWLADRVAPGSAPAAAAPAVPAVADAAPVRSLGALLEELRDSDDPVLVEMAPRGGGSPRTVSWRLLSRRVREIAAGLHARGLRAGDRVSLLVPPGADLTALLYACLRIGAIVVVADAGLGAKGLGRAVAGSRPDMVVGIPAGLALARALGWPGERISVTTLAPPVARALGVAASLPEIARDGRAQVLPPEPAADDDAAILFTSGSTGPAKGVVYTHRQLAALRDMLGGRFDVGVGTGLVAGFAPFALLGPALGATSVTPDMDVTRPHDLTASALAAAARAADATVVFASPAALANVVATEDALTSDDRAALGRVRSLLSAGAPLSEALLTRAAALVPAAEVHTPYGMTEGLLLTDVTLEGIRQAALRGDAGVCVGAPVDPVAIRISPLDADGAATGALTAEPGVTGEIVAAAPHVHDRYDRLHVTDRAARRDSDDGIRRHRTGDVGHLDATGALWVEGRLPHVITTADGVLTPVGPEQRAESAPGVGRAAAVGVGPAGVQQLVLVVETVPTARRVGLADPDLATAVRAAVGHPVAAVIVVPVLPTDVRHNSKVDRARLGRWAAGILSGGRVSAP

SEQ ID NO: 139 - protein, 913 aa, Brevibacterium linens
MRFPARPAQAPPKLPEWDPAWSRIVEAKTPEGPHSFHVLDTLEVLRGEGLEPSGTILALHGNPTWSYLWRHLAQATVGAARSGGRVWRLIAPDQLDMGFSERLAHESLPTPHGAEVRRMSQRITDFDAVVTPLLAEVAGSAAPNAGTAPNDGATSVDHPIVTIGHDWGGVLSLGWASRNTDLVSASISLNTAVHQPEDAPIPAPLRATLAGPMLPTATVVTDGFLRVTMSLGDLDPEIKDAFRSPYDNASLRHGIGGFVADIPVDENHPSYSELQRVGADIAANEHPALLVWGPKDPVFLERYLRDLRQRLPQADVHRFELGSHLVSEDYDVAGVVTDWLETQFPASTDTNADNVQSPDAEPPARGVTAILDARHDDESIASVDFAQNPAQQISWRHLWHVTTSIAGGLLELGVRPGDRVSMLVPPGNNLTAALYACLKIGAVAVVADAGLGPKGMTRATTSADPQWIIGELPGLGLARAFNWPGRRISVSPLGAVQAKLLKVETSLTALSRTTHHAQLPTPAATDDAAILFTSGSTGPAKGVRYTHGDISALAAVLTRVFDVREGTGLVAGFPPFALLGPAIGATSVTPDMSVTKPKTLTASAISDAIIAGHSTMVFASPAAYKNVAATASDLDEEQKAACARVELVLSAGAPVPLELMDSIAEVFPNASIHSPYGMTEGLLLTDIDRAGVAAADATANLGVCVGRPIDGVELALAPIDDSGASADVLEQGVDAQGHLGEFVVSAAHIKSGYDNLWATTAASARDDLDGRTWHRTNDIGHIDAEGRVWLEGRLQHVVTTPRGPVGPGGLEALIDSDEQVSRSSIVGIGPAGTQSLVAVLDAEGTELSPGLAPLDLTARLRELVADTVGHDLTAVLIAPTFPTDIRHNSKIDRSRLATWADHVLSGGSVRTKV

SEQ ID NO: 140 - protein, 867 aa, Congregibacter litoralis
MVDAAPNTTAAAESAIDLSADLRADLLADLKAELPADLPGLDPSWSRWVEAGGHVFHVLDNRVADATLTLVCVHGNPTWSCTWRKVISEAGANVRVIALDQLDMGFSQRTGTTRRLGQRIADLNAVINALNITTPIITVGQDWGGAISLGWATQNVHRLAGVVVANTAVHQPEGARAPLLIRMVRPFIKWVCVRLPLFVWGTTVLARPPLRGTLRDAYLAPYRSAKRRTAVGDFVADIPLEPEHPSYDDLSAIAEGLARLADIPALMLWGPSDPVFSDLYLRDLEQRLPHADVHRFIGAGHLVVEDADVAGTIHRWINAEPAPKTMAAEKRPPLWSALDKLDRDTRIAVTEATPDGTQSITFSELAITVRQTAAGMAAHGINKGDRVALLIPPGINLSIALYACWRRGAVVVLADAGLGPVGLTRAMASASPQYVIGINRALAAARLLGWPGERISATILSTMEKRILGATSSLPELQTLGQSDPLPNAPLDDDPAAVVFTSGSTGPAKGVAYGHHQLQAQRDALMSAYAITESDRLVAAFAPFALYGPAMGIPSMVPNLKVTSPGTLSAEALAEAVAAIDATLVFASPAALSNVAATADALSPAMSRAFQTVRVLLSAGAPVHPKVLRSAVALMPNAEAHTPYGMTEVLPVADITLREIERAGPGNGVCVGVPLQDVIVRISPLTGTGATSDALIEAPEVTGEIVIQAPHMRESYDKLWATQQAAATPPGWHRSGDVGHFDDQGRLWVEGRMADIITTSEGPLTTVGIEQAIEELPDITQAAVVGIGPSGTQQVVAVICPADPPRKPRLAAIDRADAVRSAAKVSISAVLEIPQMPVDRRHNSKIHRGELANWAARILAGGRMSSP

SEQ ID NO: 141 - protein, 978 aa, Micrococcus luteus
MPQIPAAPAALPPADRLPGWDPAWSRLVEIRSAADPEGTVRTLHVADTGPVLAAAGAEIVGTIVAVHGNPTWSWLWRSLLAETVRRARRGMAAWRVVAPDQLDMGFSERLAHAGSPSAASMGRAGDTYRTLGGRIADLDALLTALGLRDLAATGHPLITLGHDWGGVVSLGWAARHPELVAGVATLNTAVHQPEGAPIPAPLQAALAGPVLPASTVTTDAFLSVTTSLATPALDRETRAAYHLPYDTAARRGGVGGFVADIPADPGHGSHPELQRVGEDLAALGRTDVPALILWGADDPVFLDRYLDDLRDRLPHARVHRYERAGHLLVDDRDITAPLLQWAQLLRGGQLSDPASGLPGPVPHATADAAADPGLEVDLGEDPGAREPGVVRLWDHLRDWGAPGSDHREYTALVDMAGAQAGRSLVGTARRPVAVTWGELQEMVSAIATGLWAAGMRPGDRVAMLVPPGRDLSAALYAVLRVGAVAVVADQGLGVKGMTRAMKSARPRWIIGRTPGLTLARAQSWPGTRISVTEPGAAQRRLLDVSDSLYAMVDRHRDPAAGDAVDEHGTVLPEPALDADAAVLFTSGSTGPAKGVVYTHERLGRLVALISRTLGIRPGGSLLAGFAPFALLGPALGAASVSPDMDVTQPATLTAQKLADAAIAGQSSVLFASPAALANVVATADGLDAPQREALDAVRLVLSAGAPVHPQLMRQVSDLMPNARVHTPWGMTEGLLLTDIDGDEVQRLRTADDAGVCVGSALPTVSLAIAPLLEDGSAEDVILDPARGHGVLGEIVVSAPHLKDRYDALWHTDQQSKRDGLWRRDGRVWHRTADVGHFDAEGRVWLEGRLQHVITTPEGPVGPGGPEKTVDALGPVRRSAVVGVGPRGTQAVVVVVEAAVPATRPARRPGHHRDGRPKQGLAPTALASAVRAALEPLPVAAVLVADEIPTDIRHNSKIDRARVADWAEAVLAGGKVGAL

SEQ ID NO: 142 - protein, 336 aa, Xanthomonas oryzae
MKLLVTGGGGFLGQALCRGLRARGHEVVSFQRGNYPVLQSLGVGQIRGDLADPQAVRHALAGIDAVFHNAAKAGAWGSHDSYHQANVVGTQNVIEACRATGVPRLIYTSTPSVTHRATNPVEGLGADEVPYGDNLRAAYAATKAIAERAVLAANDAQLATVALRPRLIWGPGDNHLLPRLAARARAGRLRMVGDGSNLVDSTYIDNAAQAHFDAFEHLAVGAACAGKAYFISNGEPLPMRELLNRLLAAVDAPAVTRSLSFKTAYRIGAVCETLWPLLRLPGEVPLTRFLVEQLCTPHWYSMQPARRDFGYVPGISIEEGLQRLRSSSSNDIAITG

SEQ ID NO: 143 - protein, 329 aa, Gemmata obscuriglobus
MKAVVTGGGGFLGGAVVRLLRQRGDSVRSFTRSAYPWLDELGVEQSLGNLSDLESVERAVSGCDVVFHVAAKAGVWGRYSAYYSTNVVGTQNVIAACKTHGVRRLVYTSTPSVVHAGGDNEGANESLPYPKHFDAAYPETKAKAEKAVLAANGSDLATVSLRPHLIFGPGDPHLIPRIIDSARAGKLKRIGNRPAKVDVTYIDNAAQSQLDAADRLDIGTAPAGKAYFISNGEPVELWPFVDRILAEAGLPPVTARVSAWKARLAGRVLESVYWLFRLPGEPPMTRFVANQMSTSHWYDISAARRDLGYEPKVSVEEGLRRLGERLRLA

SEQ ID NO: 144 - protein, 323 aa, Arthrobacter chlorophenolicus
MKVLVTGASGMLGGTVARLLVREGHTVTTLQRRPSGVDGATDLCGSITDARVLKDAVRGQDGIIHLAAKVSFTGRAAEFDEVNIEGTRLLLEAAREAGVPDFVFVSSPSVANSGAAIVGLGAGPADPEHAHGDYARTKGAAELLALAADSPGFRVAAVRPHIVWGPGDTQLVERVLARAAVGRLPLLDAGAALIDTTYVENAASAMVAALERMEKVHGQAVVVSNGEPRPVGELIAGICAAGGVAAPSWAVPGAVARGIGAVVEKIWLWAGRTEEPPMTKFLAEQLSTAHWFDQRRTRELLDWTPAVSLDEGLAKLAAHYQPR

SEQ ID NO: 145 - protein, 332 aa, Xylella fastidiosa
MKILVTGGSGFLGEALCRGLLKRGYQVLSFQRSHYQALQALGVVQICGDLSDFHAVRHAVRGVDAVFHNAAKVGAWGSYTSYHQINVIGTQHVLDACRAENISKLVYTSTPSVIHRSNYPVEGLDADQVPYSNAVKVPYAATKAMAEQAVLAANSVDLTTVALRPRMIWGPGDPHLMPRLVARARAGRLRLIGDGRNLVDSTYIDNAAQAHFDAFEHLMPGAACAGKAYFISNGEPLQMRELINKLLATANAPPVTQSLSFKTGYCIGAFCEMLWSLLPLPGEPLLTRFLVEQMSTPHWYSIEPAKRDFGYVPRVSIEEGLVRLLSETRVTG

SEQ ID NO: 146 - protein, 332 aa, Xylella fastidiosa
MRILVTGGSGFLGEALCRGLLKRGYQVVSFQRSHYQALQALGVVQICGDLSDFHAVRHAVRGVDAVFHNAAKVGAWGSYTSYHQINVIGTQHVLDACRAENINKLVYTSTPSVIHRSNYPVEGLDADQVPYSNAVKVPYAATKAMAEQAVLAANSVDLTTVALRPRMIWGPGDPHLMPRLVARARAGRLRLIGDGRNLVDSTYIDNAAQAHFDAFEHLMPGAACAGKAYFISNGEPLQMRELINKLLATTNAPPVTQSLSFKTGYCIGAFCEMLWSLLPLPGEPLLTRFLVEQMSTPHWYSIEPAKRDFGYVPRVSIEEGLVRLLSETRVTC

SEQ ID NO: 147 - protein, 349 aa, Opitutaceae bacterium
MTSARPARPAHPTAPPRTPQKILVTGGAGFIGSHLCEALLADGHHLVVLDDFNDYYPPALKHAHLAPIRDQLDALVQADIRDPAAIERTFATHHPIHAVYHLAARAGVRPSIHSPRLYLSTNIDGTLNLLEACRAHHVPDFILASSSSVYGANPKTPFAETDPIQRTLSPYAASKLAAEQLCSNYAHLHGLRCLCLRLFTVYGPRQRPDLAIARFTAAIRDGRPIDLYGDGTTARDYTYVDDIIQGLLAAGRRTATLPPATFEIFNLGESATTTLNELVTLIENALGRPALIRRQPEQPGDVPRTYADISKARRLLGYAPATLPADGIRKYIRWLETNQPAPASLQIGR

SEQ ID NO: 148 - protein, 402 aa, Shewanella baltica
MTIDPIKSTTLAQFDAAEQTALAQLALKVQHAFVTGAGGFLGKAICLRLLAAGIKVTGFARGHYPELEALGVVMLQGDLVNKDQLQQAMQGCDIVFHVASKAGVWGDRDSYFCPNVKGAANVIAACKTLKINKLVYTSTPSVTFAGQDESGIDESTPYATSFLNYYAHSKAIAEKMMLDANQVGDVSVENTAVTQVTQVTQATTATISDNNLATTQVAIPNTSQVTAPYALKTVALRPHLIWGPGDPHLVPRVLARCRLDKLKLVGHEDKLVDTIYIDNAAYAHVLAALELCQAKPKCQGKAYFLSNDEPITMAKMLNLILACDALPPVTKRVPQSVAYVAGAVLETVYFLLKKQEEPMMTRFVARQLSCSHYFDISAAKRDLGYRALVSINEGMARLKASL

SEQ ID NO: 149 - protein, 197 aa, Desulfatibacillum alkenivorans
MKILVLLAHPDKNSFNHAIAQTVVDQLELSGHKVFFHDLYEEGFDPLLPAEEIPSEAKLPPEIDSHCWELALAEGIVIVHPNWWGQPPAILKGWVDRVVRPEVAYRFLEGDGGEGVPVGLLKAQTAVVLNTSNTPGHREDEVFGDPLDILWRECIFGLCGVEFFHRRMFRVVCTSTEEERRGWLTEIKQLVKSAFNE

SEQ ID NO: 150 - protein, 338 aa, Stenotrophomonas maltophilia; identical to SEQ ID NO: 4

SEQ ID NO: 151 - protein, 338 aa, Stenotrophomonas maltophilia; identical to SEQ ID NO: 4

SEQ ID NO: 152 - protein, 338 aa, Stenotrophomonas maltophilia; identical to SEQ ID NO: 2

SEQ ID NO: 153 - protein, 338 aa, Xanthomonas campestris
MLFQNVSIAGLAHVDAPHTLTSKEINERLQPTYDRLGIKTDVLGDVAGIHARRLWDQDVQASDAATQAARKALIDAGIGIEKIGLLVNTSVSRDYLEPSTASIVSGNLGVGDHCVTFDVANACLAFINGMDIAARMLERGEIDYALVVDGETANLVYEKTLERMTSPDVTEEEFRNELAALTLGCGAAAMVMARTELVPDAPRYKGGVTRSATEWNKLCRGNLDRMVTDTRLLLIEGIKLAQKTFMAARQVLGWAVEELDQFVIHQVSRPHTAAFVKSFGIDPAKVMTIFGEHGNIGPASVPIVLSKLKELGRLKKGDRIALLGIGSGLNCSMAEVVW

SEQ ID NO: 154 - protein, 338 aa, Xanthomonas campestris
MLFQNVSIAGLAHIDAPHTLTSKEINERLQPTYDRLGIKTDVLGDVAGIHARRLWDQDVQASDAATQAARKALIDANIGIEKIGLLINTSVSRDYLEPSTASIVSGNLGVSDHCMTFDVANACLAFINGMDIAARMLERGEIDYALVVDGETANLVYEKTLERMTSPDVTEEEFRNELAALTLGCGAAAMVMARSELVPDAPRYKGGVTRSATEWNKLCRGNLDRMVTDTRLLLIEGIKLAQKTFVAAKQVLGWAVEELDQFVIHQVSRPHTAAFVKSFGIDPAKVMTIFGEHGNIGPASVPIVLSKLKELGRLKKGDRIALLGIGSGLNCSMAEVVW

SEQ ID NO: 155 - protein, 338 aa, Xanthomonas campestris; identical to SEQ ID NO: 154

SEQ ID NO: 156 - protein, 338 aa, Xanthomonas oryzae
MLFQNVSIAGLAHVDAPHTLTSKEINGRLQPTYDRLGIKTDVLGDVAGIHARRLWDQDVQASDAATQAARKALIDAGIGIEKIGLLVNTSVSRDYLEPSTASIVSGNLGVGDHCVTFDVANACLAFINGMDIAARMLERGEIDYALVVDGETANLVYEKTLERMTSPDVTEEEFRNELAALTLGCGAAAMVMARTELVPDAPRYKGGVTRSATEWNKLCRGNLDRMVTDTRLLLIEGIKLAQKTFLAARQVLGWAVDELDQFVIHQVSRPHTAAFVKSFGIDPAKVMTIFGEHGNIGPASVPIVLSKLKELGRLKKGDRIALLGIGSGLNCSMAEVVW

SEQ ID NO: 157 - protein, 338 aa, Xanthomonas campestris; identical to SEQ ID NO: 154

SEQ ID NO: 158 - protein, 338 aa, Xanthomonas axonopodis; identical to SEQ ID NO: 12

SEQ ID NO: 159 - protein, 338 aa, Xanthomonas oryzae
MLFQNVSIAGLAHVDAPHTLTSKEINERLQPTYERLGIKTDVLGDVAGIHARRLWDQDVQASDAATQAARKALIDAGIGIEKIGLLVNTSVSRDYLEPSTASIVSGNLGVGDHCVTFDVANACLAFINGMDIAARMLERGEIDYALVVDGETANLVYEKTLERMTSPDVTEEEFRNELAALTLGCGAAAMVMARTELVPDAPRYKGGVTRSATEWNKLCRGNLDRMVTDTRLLLIEGIKLAQKTFLAARQVLGWAVDELDQFVIHQVSRPHTAAFVKSFGIDPAKVMTIFGEHGNIGPASVPIVLSKLKELGRLKKGDRIALLGIGSGLNCSMAEVVW

SEQ ID NO: 160 - protein, 338 aa, Xanthomonas oryzae; identical to SEQ ID NO: 156

SEQ ID NO: 161 - protein, 338 aa, Xylella fastidiosa
MLFNNVSIAGLAHIDAPCTLTSQEINARLQPMLERIGIKSDVFADIVGINARRLWNTNVQTSDVATMAARKALQDAGVAVDRIGLVVNTSVSRDYLEPSTASIVSGNLGVGEQCIAFDVANACLAFLNGMDIAGQMLERGDIDYALVVNAETANRVYEKTLERMSAPGVTEQEFREEMAALTLGCGAVAMVLARTALVPDAPQYKGGVTRSATEWNKLCCGNLDRMVTDTRLMLIEGIKLAKKTFVVAKQVLGWVEEELDQFVIHQVSRPHTEAFIKSFGIDPAKVMTIFREYGNIGPASVPIVLSKLKELGRLKKGDRIALLGIGSGLNCSMAEVVW

SEQ ID NO: 162 - protein, 338 aa, Xylella fastidiosa
MLFNNVSIAGLAHIDAPCTLTSQEINARLQPMLERIGIKSDVFADIVGINARRLWNTNVQTSDVATMAARKALQDAGVAVDRIGLVVNTSVSRDYLEPSTASIVSGNLGVGEQCIAFDVANACLAFLNGMDIAGQMLERGDIDYALVVNAETANRVYEKTLERMSAPGVTEQEFREEMAALTLGCGAVAMVLARTALVPDAPQYKGGVTRSATEWNKLCCGNLDRMVTDTRLMLIEGIKLAKKTFVVAKQVLGWVVEELDQFVIHQVSRPHTEAFIKSFGIDPAKVMTIFREYGNIGPASVPIVLSKLKELGRLKKGDRIALLGIGSGLNCSMAEVVW

SEQ ID NO: 163 - protein, 338 aa, Xylella fastidiosa
MLFNNVSIAGLAHIDAPCTLTSQEINARLQPMLERIGIKSDVFADIVGINARRLWNTNVQTSDVATMAARKALQDAGVAVDRIGLVVNTSVSRDYLEPSTASIVSGNLGVGEQCIAFDVANACLAFLNGMDIAGQMLERGDIDYALVVNAETANRVYEKTLERMSAPGVTEQEFREEMAALTLGCGAVAMVLARTALVPDAPQYKGGVTRSATEWNKLCCGNLDRMVTDTRLMLIEGIKLAKKTFVVAKQVLGWAVEELDQFVIHQVSRPHTEAFIKSFGIDPAKVMTIFREYGNIGPASVPIVLSKLKELGRLKKGDRIALLGIGSGLNCSMAEVVW

SEQ ID NO: 164 - protein, 348 aa, Plesiocystis pacifica
MRFANVSICSVAHVDAPYRVSSTDLENRLAAPMQRLGLPPGILETLTGIKARRMWPASVSPSDAATLAARRAIAESGVDPERIGVLISTSVCRDFVEPSTACLVHGKLGLPPTCLNFDVGNACLGFINGMDIIGNMIERGQLDYGIVVDGEDSRYVIDKTIERLSAPDSTREDFWSNFATLTLGGTAAAMVLARTDLAQALAEKRAEGGYSHQFLGSVIVAATQHSGLCRGQVDRMETDSAELLTAGLRVAKEAWRAAQREFGWTPGALDECVIHQVSRTHTDKFCETFELDPAKLLATYPEFGNVGPAGVPMVLSKAASSGRLGRGDRVGLMGIGSGLNCAMAEVVW

SEQ ID NO: 165 - protein, 339 aa, Chloroflexus aggregans; identical to SEQ ID NO: 18

SEQ ID NO: 166 - protein, 339 aa, Chloroflexus aurantiacus
MLFRHVMIEAVSYVLAPHRITSDWIEDQIAETMERLRFPRGKLEALSGIRERRFWDEGTLPSTVATMAAERLLDQVAIDRERIGLLINTSVCQDYLEPSTACFVHRNLGLSPRAINYDVRNACLGFLNGMAIAGMMIEAGTIEYALIVDGEGAQDAVMATIRRLRRPETTKQDLRDNFATLTLGSGGAAMLLTHERFARNGHRLNGVVTLAATQYNHLCLGQPDYMKTDAGALMHAGVELAVDTWRLAQEVLPNWSDRQIALYAPHQVGARHMAAVTKALHITPSKLFLNFPTLGNVGPAALPISLAQAAEAGRLRAGDHVGLLGIGSGLNCSMMSVTW

SEQ ID NO: 167 - protein, 344 aa, Arthrobacter sp. FB24
MNQTLPGAARIAGLEVYVPPGRMGTGQLEEQLAAASPGFRVPKGLIGRLTGIRTRSVMAGTEQASDLAAVAAAKLLAHRGLQPADVDLLLFASASQDMVEPATGHMVAAKLGVGCPVMDIKNACNSILNGLEVADALIGAGRYRRVLLVSGESPSRAVRWSVPDQETFAAAFPGYTMSDAGCAVLLEPADPDDDAGPRVLGTGFTAKSSHWAVGTLPTGGSVAPRDPEATYFNMDGEKLKDAFLDLGRGILDETLERLGLSWADFAVVCVHQVSAPYRDIFARGAGVPPDKLVRTVEEYGNMASVSLPLQLKVAQDLGRCGPGDLVALVGLAGGVSLGIAVVRL

SEQ ID NO: 168 - protein, 340 aa, Arthrobacter aurescens
MAGNATFRHSNTALLSVSSVEAPRIVSSTDFDRRLASTLQRLKFPPRLLERVAGITHRRWWAAGTSFDDAAVEAGAKALAEAGVEASEVGLLINTSVTRRNLEPSVAVKIHHELGLPSSAMNFDLANACLGFVNGLILAANMIDSGQIRYAVIVNGEDAQGTQEATLARLQRPETTREDFNREFATLTLGSGAAAAVLGPRDEYPGAHRLVGGVMRAGTEHHELCVGGIDGMSTDTKGLLDGGLQLVVDAWHEAQPEWDWASMDRYVTHQVSNAYTQAIINAIDLDPDKVPITFPHWGNVGPASLPMTLAAQAQSLTSGDRVLCMGVGSGLNAGMVEIVW

SEQ ID NO: 169 - protein, 356 aa, Photobacterium profundum
MSKLYSLMKYSRVFINSLAYELAPQVVSSSELEFRLAPLYQKFRIPMGQLAALTGIEERRWWPKGHVLSDGALLAARKAIDETGINVGDLGAVVYTGVCRDQHEPATACRIAAELGVSKNTAIYDISNACLGVLSGILDIANRIELGQIKAGLVVSCESARHIVDITIDHMLAEPTMQNFAQSLATLTGGSGAVAVILTDGSLPLRNERQHQLLGASHLSAPEHHDLCQWGLQEVGPQLYREFMRTDGVTLLKEGVQLARDTWSHFLAQRDWVVENVDKVICHQVGASNRRQVLNALNIPVNKEFPTYKLMGNMGSVSLPATAAMAHDHGFLKSGDNVSFLGIGSGLNCMMLGLKW

SEQ ID NO: 170 - protein, 342 aa, Streptomyces ambofaciens
MSEAIRARIAAVCAHLPSRYRTLDETRAKITETGGYAPPPGLLEDLTGVRGVHVHEDGENSSDLAVAAARSALEQAGLKIRDVDLLLFASTSQDLIEPATAHLVATKLGASCPVFDVKNACNSFLNGMEVAASFIETGRYRTVLIACGEPATLATRWHLPTREDLLRALPGYTASDAGAAMVLTAGPAGDGDPGILSLRFVSNSPAWEACTVAGGGSMHHLSVHDDHTTLRLNGDLWQSALDVLPRIMDTAGEEFRAAQAGAVSFIAFHQIAMPQYREVIDLFSLPEDRCMPAVAEHGNCAAASLPLQLAKAREADRIEGGDLVAMIGLASGFSFGLALVRW

SEQ ID NO: 171 - protein, 330 aa, Streptomyces ambofaciens
MSLYSRIIQVAVHLPEGRQSARAIEDRLREHSPGVRVPAGLLSRLYGLHERVVAADGDLPCGLASHAVGRVLAQAGLAPDDVDLLLFAAVSADVQEPANAHIVAARTGLSCPVFDVSNACNSVLNALEVADAFIRAGRYRRILIACGETLSRLSRWNLTPATLRTGLASLTGGDMGAALLVEASPRPGIIAHTFMANSAGWPAATLFNPHHAPGGPPGLHIDSDKLLASFLGIDTRAAQWLKEQHTDPNELGLVCLHQPSVPFVRTFCERLSIQPDTVVPTFHRTGNMGAATLPLQLAHAADQGRLRPGTQVVLFGMASGASGGVMLISW

SEQ ID NO: 172 - protein, 349 aa, Shewanella oneidensis
MKYSRVFINSLAYELAPVVVSSSELESRLAPLYQKFRIPMGQLAALTGITERRWWPKGHQLSDGAINAAHKAIAETGIDVAELGAVVYTGVCRDQHEPATACRIAAALGVSKDTAIYDISNACLGVLSGILDIANRIELGQIKAGMVVSCESARDIVDVTIDNMLADPTMQNFAQSLATLTGGSGAVAVILTDGSLPLTNVRKHQLLGASHLSAPQHHQLCQWGLQEVGHNIYREFMRTDAVTLLKEGVELAKHTWEHFLAQRNWLVEQVDKVICHQVGASNRKQVLSALNIPPEKEFPTYQLLGNMGTVSLPVTAAMAHDQGFLRPGDQVSFLGIGSGLNCMMLGIKW

SEQ ID NO: 173 - protein, 407 aa, Rhodopirellula baltica
MFDTHLESPPFQDSFIDVPKSKARFLTGLGTGRTATVHFPDVALASIGVTIPRAQWTSEQIEKDLQPLYSRLKLPEGRLAMMSGIDSRRVWEPGTVPSGPSIESGRKALEAASVDPNQIGALIHASVCRDFLEPATASRVHHELGLSPDCWVYDVSNACLGVLNGAVQIAGMIQSGMISAGIVVGTENSRPLMEATIASLNADDQLTRKTVKPAFASLTIGSGSCAWLLTHRDLNPGATILEHAIARAHTAHHHLCRSDQDTAGAGMQPLMETDSETLMAEGIATGVAALNELLQQSGWSRDQIDRSVCHQVGSRHRIGMLEAMQLPETRDSVTFPALGNTGSVALPLTVAAAAATGELSAGDRTAMLGIGSGINSVMIAAKWGETAVAGDWAGLLDELAPSRLASC

SEQ ID NO: 174 - protein, 344 aa, Desulfotalea psychrophila
MFKYSNVCLDTFGYSLPPRVLSSADIESSLAPLYDRLHLPEGRLELMSGIRERRLWPKGMKPSEAAYLAGKKTLDDGGIAAAEVECLLFTSVCRDMMEPATSAFVHHKLGLPKSCLVFDISNACLGFLDGMVMLANMIELGQVKNGLVVSGETAEDLLESTIAALNADETFTRKTIKSSFASLTIGSGSVGCFMRRAEAGETKPRLVRGVWRTDTDHIHLCQGDAQGGETTLMQTDSEELLLRGVDTAAAAWDAFAAPGWRNEEVDAYCCHQVGVAHFRMLFDRLGLSEEKNFQTLPFLGNVGTVSAPITLAMAMEEGAFKPGERAVMLGIGSGINSIVLGIDW

SEQ ID NO: 175 - protein, 349 aa, Colwellia psychrerythraea
MKYSRVFINSLAYELAPEVVTSAELESRLTPLYQKFRIPKGQLTALTGIEERRWWPTDHMLSDGAIVAAQKAMNETGIAAADIGAVVYTGVCRDQHEPATACRIAAKLGVLKDTAIYDISNACLGVLSGILDIANRIELGQIKAGLVVSCESARHIVDVTIDDMLADPTMQNYARSLATLTGGSGAVAVLLTDGSLNLDTDRNHQLLGASHLSAPEHNNLCQWGLKEVGPQLFREFMRTDAVSLLKEGVSLAKDTWEHFLEQRQWVEGQVDKVICHQVGAANQKQVLTALCINPEKEFPTFKLLGNMGTVSLPVTAAMAHDQGFLQKGDNVSFLGIGSGLNCMMLGLKW

SEQ ID NO: 176 - protein, 349 aa, Shewanella denitrificans
MKYSRVFINSLAYELAPLVVSSLDLESRLGPLYQKFRIPMGQLAALTGITERRWWPKGFRLSDGAISAARKAIDETGIAVSDLGAVVYTGVCRDQHEPATACRIAAELGVSKDTAIYDISNACLGVLSGILDIANRIELGQIKAGMVVSCESARDIVEATIDNMLADPTMQNFAQSLATLTGGSGAIAVILTDGSLPLKTARQHQLLGASHLSAPEHHQLCQWGLQEAGHLLYREFMRTDAVTLLKEGVDLAKHTWEHFLSQRDWLVEQVDKVICHQVGASNRRQVLNALNIPHEKEYPTYQTLGNMGTVSLPVTAAMAHDEGFLKVGDQVSFLGIGSGLNCMMLGIKW

SEQ ID NO: 177 - protein, 349 aa, Shewanella sp. MR-4
MKYSRVFINSLAYELAPVVVSSSELESRLAPLYQKFRIPMGQLAALTGITERRWWPKGHQLSDGAIKAAQKAIAETGIEVAELGAVVYTGVCRDQHEPATACRIAAALGVSKDTAIYDISNACLGVLSGILDIANRIELGQIKAGMVVSCESARDIVDVTIDNMLADPTMQNFAQSLATLTGGSGAVAVILTDGSLPLTNVRKHQLLGASHLSAPQHHQLCQWGLQEVGHNIYREFMRTDAVTLLKEGVELAKHTWEHFLTQRNWLVEQVDKVICHQVGASNRKQVLSALNIPPEKEFPTYQLLGNMGTVSLPVTAAMAHDQGFLRPGDQVSFLGIGSGLNCMMLGIKW

SEQ ID NO: 178 - protein, 349 aa, Shewanella sp. MR-7
MKYSRVFINSLAYELAPVVVSSSELESRLAPLYQKFRIPMGQLAALTGITERRWWPKGHQLSDGAIKAAHKAIAETGIEVAELGAVVYTGVCRDQHEPATACRIAAALGVSKDTAIYDISNACLGVLSGILDIANRIELGQIKAGMVVSCESARDIVDVTIDNMLADPTMQNFAQSLATLTGGSGAVAVILTDGSLPLTNVRKHQLLGASHLSAPQHHQLCQWGLQEVGHNIYREFMRTDAVTLLKEGVELAKHTWEHFLTQRNWLVEQVDKVICHQVGASNRKQVLSALNIPPEKEFPTYQLLGNMGTVSLPVTAAMAHDQGFLRPGDQVSFLGIGSGLNCMMLGIKW

SEQ ID NO: 179 - protein, 349 aa, Shewanella frigidimarina
MKYSRVFINSLAYELAPQVVSSSDLESRLAPLYQKFRIPMGQLAALTGITERRWWPKGHRLSDGAIAAARKAVNETGINVSDLGAVVYTGVCRDQHEPATACRIAAELGVSKDTAIYDISNACLGVLSGILDIANRIELGQIKAGMVVSCESARDIVDATIDHMLAEPTMQNFAQSLATLTGGSGAVAVILTDGSLPLTTTRQHQLLGASHLSAPEHHQLCQWGLQEAGHLLYREFMRTDAVTLLKEGVELAKHTWEHFLEQRDWVVEQVDKVICHQVGASNRRQVLNALNIPHEKEYPTYQTLGNMGTVSLPVTAAIAHDEGFLRVGDQVSFLGIGSGLNCMMLGIKW

SEQ ID NO: 180 - protein, 326 aa, Maricaulis maris
MTELSARIAGIGSHLPERILNNDEISAMVDTSDSWIRERTGIRQRHIAGEGVTTCDLAERAARRALEDAGIAAEELDLIVVATTTPDFTFPSVGTMLQARLGATQGAAFDVQAVCTGFVYALSMADNMIARGQAKTALVVGAETMSRILDWTDRSTCVLFGDGAGAMVLQAAEPAGEGTDRSGILGTYLRSDGRFKDLLHVDGGPSSTGTVGHLRMVGNQVFRHAITNIAESMTTIASRCGVTIEEVDWFVPHQANQRILEGVARRLSIPTEKVISTVADHGNTSAASVPLAFDRAVQDGRIKRGDLVLMEALGGGFTWGAALARY

SEQ ID NO: 181 - protein, 349 aa, Shewanella sp. ANA-3
MKYSRVFINSLAYELAPVVVSSSELESRLAPLYQKFRIPMGQLAALTGITERRWWPKGHQLSDGAIKAAHKAIAETGIEVAELGAVVYTGVCRDQHEPATACRIAAALGVSKDTAIYDISNACLGVLSGILDIANRIELGQIKAGMVVSCESARDIVDVTIDNMLADPTMQNFAQSLATLTGGSGAVAVILTDGSLPLTNVRKHQLLGASHLSAPQHHQLCQWGLQEVGHNIYREFMRTDAVTLLKEGVELAKHTWEHFLAQRNWLVEQVDKVICHQVGASNRKQVLSALNIPPEKEFPTYQLLGNMGTVSLPVTAAMAHDQGFLRPGDQVSFLGIGSGLNCMMLGIKW

SEQ ID NO: 182 - protein, 347 aa, Pelobacter propionicus
MKYRAVTLESFGYQLAPVVVSTSDLEARLEPLYRQLRIAPGQLQAMTGIRERRWWEPGYPLSQGAIAAARKALAASAVPVDQIGALIYAGVCREQFEPATACRVAHGLGIGGQAAVFDISNACLGVLNGMLDLANRIELGQIRAGMVVSCESAREINEIMIERMLKERRMEHFASSLATLTGGSGAVAVLLTDGSFSGAQRRKLLGGVCLSAPEHHQFCLWGMAPDGRGGYQQVMSTDGVNVMNHGVELGKRTWNAFLPHLGWSAEQVDQVICHQVGSAHQNAILKTLGISADQDFTTYEYLGNMGTVSLPLTAALAAERDILLTGDRVALLGIGSGLNCLMLGVEW

SEQ ID NO: 183 - protein, 349 aa, Shewanella amazonensis
MKYSRVFINSMAYELAPVVVSSSELEQRLAPLYQKFRIPMGQLAALTGIRERRWWPLGHQLSDGAIAAAKKALNETGLKATDLGAVVYTGVCRDQHEPATACRIAASLGVGRDSAIYDISNACLGVLSGILDIANRIELGQIRAGLVVSCESARDIVDATIERMLEEPTMQNFAQSLATLTGGSGAVAVLLTDGSFNLATERNHQLLGASQLAAPEHYQLCQWGLQEAGHRLYREFMRTDAVALLKEGVELAKQTWQHFLGQREWLASQVDKVICHQVGAANRKQVLSALQIPEEKEFPTFAELGNMGTVSLPVSAAIAHDQGFLRPGDQVSFLGIGSGLNCMMLGLRW

SEQ ID NO: 184 - protein, 349 aa, Psychromonas ingrahamii
MKYSNVFINSLSYELAPQVISSVELESRLAPLYQKLRIPMGQLSALTGIQERRWWPTDHILSDGAIAAARKAIAETAIDINDLGAVVYTGVCRDQHEPATACRIAAALGVNNSTAIYDISNACLGVLSGILDIANRIELGQIKAGLVVSCESARHIVDITIANMLENKTIQNYSQSLATLTGGSGAVAVLLTDGSLPLKNTRQHKLLGASHLSASEHHDLCKWGSHPVGLNLHREYMRTSAVPLLKEGVALALQTWQHFLQQRDWSVEQVDKVICHQVGSANQKKVLAALNIPPHKEFPTFQKLGNMGTVSLPVTAAIAHDQGFLVKGDKVSFLGIGSGLNCMMLGLEW

SEQ ID NO: 185 - protein, 349 aa, Shewanella sp. W3-18-1
MKYSRVFINSLAYELAPVVVSSSELESRLAPLYQKFRIPMGQLAALTGITERRWWPKGHQLSDGAINAARKAIAETGINVADLGAVVYTGVCRDQHEPATACRIAAELGVSKDTAIYDISNACLGVLSGILDIANRIELGQIKAGMVVSCESARDIVDVTIDNMLASPTMQNFAQSLATLTGGSGAVAVILTDGSLPLTNVRKHQLLGASHLSAPEHHQLCQWGLQEVGHNLYREFMRTDAVTLLKEGVELAKHTWEHFLEQRNWLVEQVDKVICHQVGASNRKQVLSALNIPPEKEFPTYQLLGNMGTVSLPVTAAMAHDEGFLQAGDQVSFLGIGSGLNCMMLGIKW

SEQ ID NO: 186 - protein, 349 aa, Shewanella baltica OS155
MKYSRVFINSLAYELAPVVVSSSELESRLAPLYQKFRIPMGQLAALTGITERRWWPKGHQLSDGAIKAARKAMVETGIDVADLGAVVYTGVCRDQHEPATACRVAAELGVSKDTAIYDISNACLGVLSGILDIANRIELGQIKAGMVVSCESARDIVDVTIDNMLADPTMQNFAQSLATLTGGSGAVAVILTDGSLPLTNVRQHQLLGASHLSAPEHHQLCQWGLQEVGHNLYREFMRTDAVTLLKEGVELAKHTWEHFLEQRNWLVEQVDKVICHQVGASNRKQVLSALNIPPEKEFPTYQLLGNMGTVSLPVTAAMAHDQGFLQAGDQVSFLGIGSGLNCMMLGIKW

SEQ ID NO: 187 - protein, 329 aa, Burkholderia pseudomallei
MAQSTLYSRVLGTGSYLPPDRVTNQELADRLAKDGIETSDEWIVARTGIRARHFAASDVTTSDLALVAAQRAIEAADVDPQSIDLIIVATSTPDFVFPSTACLLQNKLGIKNGGAAFDVQAVCSGFAYALATADSFIRTGQHRTALVIGAETFSRILDFKDRTTCVLFGDGAGAVVLSASEEPGILGSALHADGSYSNILCTPGNVNRGVIAGSAFLHMDGQAVFKLAVNVLEKVAVEALSKAELASEQVDWLIPHQANIRIMTSTCRKLGLPQERMIVTVDEHGNTSAASIPLALDVAVRDGRIKRGQHVLIEGVGGGFTWGASVFRF

SEQ ID NO: 188 - protein, 349 aa, Shewanella loihica PV-4
MKYSRVFINSLAYELAPEVVSTSELESRLAPLYQKFRIPMGQLAALTGIHERRWWPKGHRLSDGALAAAHKSIEETGIDVADLGAVIYTGVCRDQHEPATACRIAAELGVSKDTAIYDISNACLGVLSGILDIANRIELGQIKAGLVVSCESARHIVDITIDNMLAEPTMQNYAQSLATLTGGSGAVAVLLTDGSLPLKSERQHQLLGASHLSAPEHHNLCQWGLQEAGTQLYREFMRTDGVALLKEGVELARHTWAHFLEQRNWLVEQVDKVICHQVGASNRKQVLSALNIPQEKEFPTYQLLGNMGTVSLPVTAAMAHDQGFLRKGDQVSFLGIGSGLNCMMLGLKW

SEQ ID NO: 189 - protein, 343 aa, Clavibacter michiganensis
MLLNGNATFRHRNTSLLGLASVLAPHTVTSVEIDDRLKPVLSRLRLPTGLLQRVAGVLERRNWDASMSFDAAATEAGRKALAQAGVEASQIGLLINTSVTRAHLEPSVAVSIHNGLGLPSSALNFDIANACLGFVNAMTLAGHLIDSGQIDYAMIVDGEDAGEIRHNTVARLLRPETTRADFLSEFPSLTLGAGAAAAVLGRTSDHPEGHRILGGVTRAATQHHELCIGDVDGMFTDTKELLRGGMELVVDAWKEAAQDDWDWSDMDRYILHQVSDVHTNAIVKAAKLDKSRVPLTYPRYGNVGPASIPITLADQADSLSRGDRVLCMGVGSGLNTAMTEILW

SEQ ID NO: 190 - protein, 347 aa, Geobacter uraniireducens
MKYSKVYIEALGYELAPVVVTSSELEARLEQLYRALHFAPGQLQALTGIRERRWWEPGYPLSQGAIAAGKKALAASGISPADIGALIYTGVCREQFEPATACRVAAGLGIRGNTAVFDLSNACLGVLNGILDVANRIELGQIRAGLVVSCESAREINDIMISRMLEERNMANFAVSLATLTGGSGAVAVLLTDGSFTPAKRRRLLGGITQAAPEHNGLCLWGMTSDGKGGYTQSMSTDGVNVMNYGVELGRRTWEAFLPEVGWRNEEIDRVICHQVGSAHQSAILKTLGIPLEKDFTSYEFLGNMGTVSLPLTAALAEEREMLSPGDRVALLGIGSGLNCLMLGVEW

SEQ ID NO: 191 - protein, 336 aa, Clostridium botulinum
MRSRIKGVGRYLPNRIVTSEEAEELAGFKKLGVRKGLCKMLTGCEERRYSDTNEYSSHIAAKAAIDAMKKAGVSSDEVDALIFCSVSQDFAEPATANVVMDLLNIKNAFGFDVKNACNAFLTGIDIADSLIKTGKADIVLVVSGEALSKWINFKFESKEELIRRAPVTLSIGDGGGAFIMEREEDDNKGIVKGIFRTYAEYWNNNVVWGGGVRFPRDSDKMYIPGTTKIIIDEQRNLGKNLLPILEREVGWNFQKDVDCYIPTQVAKWINKSMSNELSFPIEKIIQVVDKFGNVGASNIPIATYEAIMDGRLKTGSKTLMSGVGVGINIATIAVIL

SEQ ID NO: 192 - protein, 356 aa, Kineococcus radiotolerans
MYDPSASDRAARDGSPFHGNATFAPANAALLSISHVEAPQVVPSSYFDEVLSGTLERLRLRPGLLEKVAGVRERRWWAEGQKASDVAAECGAKALSEAGVDASEVGVVISTTVTRPHLEPAVATSVHHGMDLPPSAMNFDIANACLAWVNGVQVASAMIDSGMIRYAVVLGAEDVRSMHEGTIARLQREGITRKDFLNEFATMTLGCGAAAAVIGRADEHPEAHRIVGGVSRAGTAHHELCIGDMNHMKTDAKLMLTEGIEIVVDAFNAGDELWGWRDAEKFVIHQISKVHTETLVERIGVDAAKVPMTFPQWGNVGPISLPMTLAATAPELSPGDRVIAMGVGSGLNTAMLELQW

SEQ ID NO: 193 - protein, 336 aa, Clostridium botulinum
MRSRIKGVGRYLPNRIVTSEEAEELAGFKKLGVRKGLCKMLTGCEERRYSDTNEYSSHIAAKAAIDAMKKAGVSSDEVDALIFCSVSQDFAEPATANVVMDLLNIKNAFGFDVKNACNAFLTGIDIADSLIKTGKADIVLVVSGEALSKWINFKFESKEELIRRAPVTLSIGDGGGAFVMEREEDDNKGIVKGIFRTYAEYWNNNVVWGGGVRFPRDSDKMYIPGTTKVIIDEQRNLGKNLLPILEREVGWNFQKDVDCYIPTQVAKWINKSMSNELSFPIERIIQVVDKFGNVGASNIPIATYEAIMDGRLKTGSKTLMSGVGVGINIATIAVIL

SEQ ID NO: 194 - protein, 349 aa, Shewanella sediminis
MKYSRVFINSLAYELAPEVVSTSELESRLAPLYKKYRIPMGQLAALTGIQERRWWPKGHRLSDGALAAAHKAINETGVQVGDLGAVVYTGVCRDQHEPATACRIAAELGVSKDTAIYDISNACLGVLSGILDIANRIELGQIKAGLVVSCESARHIVDITIDNMLADPTMQNYAQSLATLTGGSGAVAVLLTDGSLPLQGERQHQLLGASHRSAPEHHNLCQWGLQEAGVHLYREFMRTDGVTLLKEGVELARDTWSHFLDQRNWLVEQVDKVICHQVGASNRRQVLNALNIPQEKEFPTYQLLGNMGTVSLPVTAAMAHDQGFLQKGDQVSFLGIGSGLNCMMLGIKW

SEQ ID NO: 195 - protein, 349 aa, Shewanella pealeana
MKYSRVFINSMAYELAPEVVSTSELESRLAPLYQKFRIPMGQLAALTGIHERRWWPKGHRLSDGALAAAHKAIDETGVQISDLGAVVYTGVCRDQHEPATACRIAAKLGVSKDTAIYDISNACLGVLSGILDIANRIELGQIKAGLVVSCESARHIVDITIDKMLAEPTMQNYAQSLATLTGGSGAVAVLLTDGSLDLKGNRHHQLLGASHLSAPEHYDLCQWGLEEAGPQLYREFMRTNGVALLKEGVELARHTWSHFLEQRNWLVEQVDKVICHQVGASNRRNVLSALNIPEEKEFPTYKLLGNMGTVSLPVTAAMAHDQGFLKSGDQVSFLGIGSGLNCMMLGLKW

SEQ ID NO: 196 - protein, 348 aa, Desulfococcus oleovorans
MRYQTVHIDAFGYELAPNVITSEELEERLAPLYTRLNLRKGQLQALTGIRERRFWDSGEPMYTGALKAGKKALAASCLSPSDIGMIVYCGVCRDNLEPATACAVADGLGLDSRTIIYDISNACLGVMTGMLEVANAIELGQIRAGMVVSCESARQIVDLTIDRMNQECDMESFKRSMAVLTGGSGAVALTMTGSQAPAAEYRRHRLLGGVVRNASQHHRLCIWGPDTGAASQFYKMETDAVGVLKNGVVLGTETFAAFRQELGFSDDKPDKVICHQVGEANQRSILKAIGVAPEKDFPTYPYLANMGTVSLPMTAAIADERGFLESGDLVGFLGIGSGLNCLMLGVEW

SEQ ID NO: 197 - protein, 349 aa, Shewanella baltica
MKYSRVFINSLAYELAPVVVSSSELESRLAPLYQKFRIPMGQLAALTGITERRWWPKGHQLSDGAIKAARKAMVETGIDVADLGAVVYTGVCRDQHEPATACRVAAELGVSKDTAIYDISNACLGVLSGILDIANRIELGQIKAGMVVSCESARDIVDVTIDNMLADPTMQNFAQSLATLTGGSGAVAVILTDGSLPLTNVRQHQLLGASHLSAPEHHQLCQWGLQEVGHNLYREFMRTDAVTLLKEGVELAKHTWEHFLEQRNWLVEQVDKVICHQVGASNRKQVLSALNIPPEKEFPTYQLLGNMGTVSLPVTAAMAHDQGFLQVGDQVSFLGIGSGLNCMMLGIKW

SEQ ID NO: 198 - protein, 349 aa, Shewanella halifaxensis
MKYSRVFINSMAYELAPEVVSTSELESRLAPLYQKFRIPMGQLAALTGIHERRWWPKGHRLSDGALAAANKAIDETGVQISDLGAVVYTGVCRDQHEPATACRIAAELGVSKDTAIYDISNACLGVLSGILDIANRIELGQIKAGLVVSCESARHIVDITIDKMLAEPTMQNYAQSLATLTGGSGAVAVLLTDGSLDLKGNRQHQLLGASHLSAPQHYDLCQWGLEEAGPQLYREFMRTNGVALLKEGVELARHTWSHFLEQRNWLVEQVDKVICHQVGASNRRNVLSALNIPEEKEFPTYKLLGNMGTVSLPVTAAMAHDQGFLKSGDQVSFLGIGSGLNCMMLGLKW

SEQ ID NO: 199 - protein, 343 aa, Clavibacter michiganensis
MLLNGNATFRHRNTSLLGLASVLAPHTVTSVEIDDRLKPVLSRLRLPTGLLQRVAGVLERRNWDASMSFDAAATEAGRKALAQAGIEPSQIGLLINTSVTRAHLEPSVAVSIHNGLGLPSSALNFDIANACLGFVNAMTLAGHLIDSGQIDYAMIVDGEDAGEIRHNTVARLLRPETTRADFLSEFPSLTLGAGAAAAVLGRTSDHPEGHRILGGVTRAATQHHELCIGDVDGMFTDTKELLRGGMELVVDAWKEAAQDDWEWSDMDRYILHQVSDVHTSAIVKAAKLDKSRVPLTYPRYGNVGPASIPITLADQADSLSRGDRVLCMGVGSGLNTAMTEILW

SEQ ID NO: 200 - protein, 349 aa, Shewanella woodyi
MKYSQVFINSLAYELAPEVVSTSDLESRLAPLYKKFRIPMGQLAALTGIQERRWWPKGHRLSDGALSAAHKAIDETGIQVSDLGAVVYTGVCRDQHEPATACRIAAELGVSKDTAIYDISNACLGVLSGILDIANRIELGQIKAGLVVSCESARHIVDITIDNMLAEPTMQNYAKSLATLTGGSGAVAVLLTDGSLPLKSDRQHQLLGASHLSAPEHHNLCQWGLQEAGVHLYREFMRTDGVALLKEGVELARHTWSHFLEQRDWVVEQVDKVICHQVGASNRRQVLNALNIPQEKEFPTYQLLGNMGTVSLPVTAALAHDQGFLQKGDQVSFLGIGSGLNCMMLGIKW

SEQ ID NO: 201 - protein, 336 aa, Clostridium botulinum
MRSRIKGVGRYLPNRIVTSEEAEELAGFKKLGVRKGLCKMLTGCEERRYSDTNEYSSHIAAKAAIDAMKKAGVSSDEVDALIFCSVSQDFAEPATANVVMDLLNIKNAFGFDVKNACNAFLTGIDIADSLIKTGKADIVLVVSGEALSKWINFKFESKEELIRRAPVTLSIGDGGGAFIMEREEDDNKGIVKSIFRTYAEYWNNNVVWGGGVRFPRDSDKMYIPGTTKVIIDEQRNLGKNLLPILEREVGWNFQKDVDCYIPTQVAKWINKSMSNELSFPIEKIIQVVDKFGNVGASNIPIATYEAIMDGRLKTGSKALMSGVGVGINIATIAVIL

SEQ ID NO: 202 - protein, 336 aa, Clostridium botulinum
MRSRIKGVGRYLPNRIVTSEEAEELAGFKKLGVRKGLCKMLTGCEERRYSDSNEYSSHIAAKAAIDAMKNAGVSSDEVDALIFCSVSQDFAEPATANVVMDLLNIKNAFGFDVKNACNAFLTGIDIADSLIKTGKADIVLVVSGEALSKWINFKFESKEELIRRAPVTLSIGDGGGAFIMEREEDDNKGIVKGIFRTYAEYWNNNVVWGGGVRFPRDSDKMYIPGTTKVIIDEQRNLGKNLLPILEREVGWNFQKDVDCYIPTQVAKWINKSMSNELSFPIEKIIQVVDKFGNVGASNIPIATYEAIMDGRLKAGSKMLMSGVGVGINIATIAVIF

SEQ ID NO: 203 - protein, 341 aa, Opitutus terrae
MRFENVCLESIAVALPEEVWTSAQIEARLQPLYDRLRLSAGRLELMTGIRERRMWPAGTRASDASAAAGRAVLQKSQLRAADVELFIHAAVSRDMLEPATASFAHRKIGLPGTAQILDVSNACLGFLNALTLAAGLIESGQIRCAMIVSGENGRPLLEQTLRTLVEQPLTRNQIKPFFANLTIGSAAVAAIVCHKSLVTGRPHRLLGGTARAATQHSDLCQGDNYAAESLVMQTDSEQLLLAGVALAQETWRDFTTEQGTDFDRFVCHQVGSVHRRKLYETLGLDLARDYSTFDRLGNTGSAALPSALALAAEAGAVTEGMRVGLLGIGSGLNCLMLALEW

SEQ ID NO: 204 - protein, 330 aa, Brevibacterium linens
MALLGLTEILAPNEVTSQEFDERLADTLSTLNLPTGLLQRVAGVDARRNWDVPSQFADGAIAAGKKALAESGVSPESIGLMVNTSVTREHLEPSVAVGVHAGIGLGSQAMNFDITNACLGFVNGMTLAANMIDAGQIEYALVVAGEDASRVQEATLRRLARPDISREEYLNEFASLTLGSGASAAVLGPADKHPEGHRILGGITRAATQHHELCVGDHNGMFTDTKGLLAGGMELVVAAWEEAHEDGWDWREMDRYVMHQVSDVHVNSITKAANLDPDRIPVTYPELGNVGPASLPITLSREASSLKPGDRILCMGVGSGLNAAMTEIEW

SEQ ID NO: 205 - protein, 383 aa, Blastopirellula marina
MNFHNVCLESFGYVLPAEIVTSDQLEARLAPLYERLRLPAGRLELMTGIRERRFWSPETLPSEISIESGRHAIEAAGIDVGEIGALVHGSVCRDHLEPATACRVHHELGLRQDCVIYDVSNACLGLLSGALQVASMIELGQIRAGLVVGTENGRQLVDNTIRTLNEDKTLTRNQIKLAVASLTIGSASCAMLLCDRELSQTQNLLHAGAVRAHTQHHQLCHSIAGSGETGVGSPLMQTDSERLMVEGIEVGGATFEDFLQKSRWSREEIQRTFSHQVGLTHRRLVLEKLGLSVDNDFATVQWLGNTGSAALPVTMAIGAQHGRIQAGDNVAMLGIGSGINCVMLGVDWQEARVSGAGELPAEVLELRSNSVGRDSSAIGAAQP

SEQ ID NO: 206 - protein, 339 aa, Congregibacter litoralis
MSGNAKFTLNDTAIVSVTAHHAPEVVTSASLDDRIMHTYERLGTQPGLLESLAGISERRWWPEGHTFTEAAAEAGRKAMAAANIKPEQVGLLIDTSVSRDRLEPSSAVTVHHLLDLPSSCLNFDMANACLGFMNAMQVAGMMLDSRQIDFALIVDGEGSRQPQEKTLERLASDEATVADLFADFATLTLGSGAAGMVLGRHSENAGSHKIIGGINRANTSHHKLCVGTLDQMRTDTAALLEAGLDVSERAWANAEEYGWLDMDRYVIHQISSVHTSMLCERLGIDVDKVPLTYPKLGNTGPAAVPLTLAQESESLNPGDRVLCLGMGSGINAMALEIAW

SEQ ID NO: 207 - protein, 349 aa, Psychromonas sp. CNPT3
MKYSRVFINSLAYELAPTVIKSSELESRLAPLYKKLHIPMGQLAALTGIIERRWWPEDHRLSDGAIMAAKKSMVETGIDINDIGAVVYTGVCRDQHEPATACRIASALGVNRSTAIYDISNACLGVLSGILDIANRIELGQIKAGLVVSCESARHIVDITIDSMLKNPSIQNFAQSLATLTGGSGATAVLLTDGSFQLKNQCQHQLLGASHLSAPEHHDLCQWGVQKIGLKLQQEFMRTNAVPLLKEGVKLANETWQHFLQQRDWTIDDVDKVICHQVGSSNQKQVLSTLQIPESKEFPTFPYLGNMGTVSLPITAAIANEQGFLKKGDNVSFLGIGSGLNCMMLGLKW

SEQ ID NO: 208 - protein, 349 aa, Photobacterium profundum
MKYSSVFINSLAYELAPQVVSSSELESRLAPLYQKFRIPMGQLAALTGIEERRWWPKGHVLSDGALLAARKAIDETGINVGDLGAVVYTGVCRDQHEPATACRIAAELGVSKNTAIYDISNACLGVLSGILDIANRIELGQIKAGLVVSCESARHIVDITIDHMLAEPTMQNFAQSLATLTGGSGAVAVILTDGSLPLHNERQHQLLGASHLSAPEHHDLCQWGLQEVGPQLYREFMRTDGVTLLKEGVQLARDTWSHFLAQRDWVVENVDKVICHQVGASNRRQVLNALNIPVNKEFPTYKLMGNMGSVSLPATAAMAHDHGFLKSGDNVSFLGIGSGLNCMMLGLKW

SEQ ID NO: 209 - protein, 347 aa, Desulfuromonas acetoxidans
MNYQNVYINAINYELPPVVVSSQELEHRLAPLYEALHMPLGQLQALTGIRERRWWQPNTPLSQGAIAAGHKALTAADVPAEAIGAITYAGVCRELFEPATACRVADGLGIGGEALIYDTSNACLGVLNGILDMANRIELGQIRAGMVVSCESARELNEVTIRRMLKEQDMALFSRSVATLTGGSGAVAVLLTDGSFNSAQSHKLLGGVALAAPQHHQLCRWGVEETAQDQLRQFMNTDAVAVMNNGVQLGLDTWKKFLPTMDWSETDIDRVICHQVGSAHQTTILKTLDIDARKDFTTFEFLGNIGTVSLPITAAIAAERGILKAGDRTALLGIGSGLNCMMLGVQW

SEQ ID NO: 210 - protein, 347 aa, Geobacter sp. FRC-32
MKYSKVHIEALGYELAPMVITSSELESRLEPLYKSLFLAPGQLQALTGIRERRWWEPGYPLSQGAIAAGRKALDASGIAPAEIGALIYTGVCREQFEPATACRVAAGLGIQGNAAVFDLSNACLGVLNGILDVANRIELGQIRAGLVVSCESAREITEIMIGRMLEERNMEHFAVSLATLTGGSGAVAVLLTDGSFSGTGRRRLVGGATQAAPEHHRLCLWGMVPDGKDGYKQTMSTDGVNVMNYGVELGLRTWQAFLKEVAWKSEDVDRVVCHQVGSAHQSAILKTLGIASDKDFTTFEYLGNMGTVSLPLTAAIADEREMLEPGEKVALLGIGSGLNCLMLGVEW

SEQ ID NO: 211 - protein, 347 aa, Geobacter lovleyi
MKYQKVVIEALEYELAPVVVSSSDLEARLEPLYRELRIAPGQLQALTGIRERRWWEPGYPLSHGAIMAARKALLSSGIAASEIGALVYTGVCREQFEPATACRVADGLGISGDVAIFDLSNACLGVLNGILDMANRIELGQIRAGLVVSCESAREINEVMIARMLEERNMQHFAHSLATLTGGSGAVAVLLTDGSFGSNAPHRLLGGITKAAPQHHNLCLWGVGPDGKGGYQQSMATDGVNVMNHGVELGRRTWEAFLPHVGWKAEQVDRVICHQVGSAHQSMILKTLGVPADKDFTTYEFLGNMGTVSLPLTAALAVERDILLPGDRVAFLGIGSGLNCMMLGIEW

SEQ ID NO: 212 - protein, 347 aa, Geobacter bemidjiensis Bem
MKYSKVFIESFGYELAPVVVTSDELEARLEPLYKTLHFTPGQLQALTGIRERRWWEPGFQLSKGAVAAGKKALSAAGVPASEIGALLYTGVCRERFEPATACRVAAGLGISGNVAVLDLSNACLGVLNGILEVANRIELGQIRAGLVVSCESAREINDIMIARMLEDRSMENFASSLATLTGGSGAVAVLLTDGSFSKSGRRRLRGGLTQAAPEHHALCLWGITPDGKGGFAQSMSTDAVSVMNYGVELGRRTWEQFLPEVGWGEHDVDRVVCHQVGSAHQSAILKTLGIPLQKDFTSYEFLGNMGTVSLPLTAALADERDVLSEGDRVALLGIGSGLNCLMLGVDW

SEQ ID NO: 213 - protein, 348 aa, Planctomyces maris
MRYEHVCVEAVCCTLPPHIVTSDEIEAQLAPVYDRLGLPAGRLELMTGIQERRFFDPGTLPGTISAQTVNKLLDHCQLDRKYIGALFHGSVCRDQLEPATASGVHHATQLPNAALVLDISNACLGLLNGMVFIANMIEMGQIRAGIVVGTEVGRDLVEGTIHDLLHDDTLTRKSIKNDFASLTIGSGSAAILLCDRKLSQTGHRLLGGNFQTDTSSHELCAGGVEAQKHGDHRPRMQTDSESLLVAGVNLAIPTWEQTKTTLGWKNEDVNRVFTHQVGKAHRKLLLEKLGLDTSLDYPTVETLGNTGAAALPMAWALGIENQILQEQDRIALLGIGSGLNSLMLGVQW

SEQ ID NO: 214 - protein, 347 aa, Lentisphaera araneosa
MYNKVKIDGFKAHIPDSILTSEAVEDMLRPAYDKLNLSKGRLEMFTGIKERRYWPLEKRPSQVSAEAAEKLISDLGVDKSEIDIVIHCSVCRDFLEPATASVVHNLLNLQPHALNFDISNACLGVITGMKVIADMIEAGTIRRGLLVSGEIGFPLLKQTIDHLNSQEHLRRQDFKPHFASLTIGSCAAAVMLSHEDLADKEKSHKLLAINSYSNTKQNDLCQGGHNNSSSNGPLMQTDSEALLVAGVDTATKAWPAFLEETQWKVEDFDRCCTHQVGSAHTRLLFESLGLNTDLDFQTFDKLGNCGSASLPATTALAAEAGHLQKGHKIALLGIGSGINCSLCAIEW

SEQ ID NO: 215 - protein, 349 aa, Moritella sp. PE36
MKYNRVFINSLTYELAPEIITSTALELRLAPLYQKLRIPVGQLAALTGITQRRWWPKDYMLSDGALIAAQKALDETGINVSDIGAVVYTGVCRDQHEPATACRIAAKLGVSNNTAIYDISNACLGALSGMLDIANRIELGQIKAGLVVSCESARHIVDVTIDDMLADPTIRNYATSLATLTGGSGAVAILLTDGSLNLAGSHNHQLLGATHLSAPEHHDLCQWGLKEIDTQLYREYMRTDAVKLLKEGVSLAQETWQQFLEQRQWTPEDVNKVICHQVGAANQKKVLTALNIPVEKEFPTFKYLGNMGTVSLPVTAAMADEEGFLKKGDNVSFLGIGSGLNCMMLGLKW

SEQ ID NO: 216 - protein, 351 aa, Opitutaceae bacterium
MKFGHTCIETLASALPDEVLTTDAIEERLRPLYERLRLPFGRLELMTGIRERRVWPTGTRPSDASAAAGRAALARSTIRADQIELFIHAAVSRDMLEPATASFAHQKIGLPPTAQVLDISNACLGFLNALTLAAGMIESGQIRCALIVSGENSRPLVDQTLTTLLDPARPLDRNGIKPYFANLTIGSGAVAAIVCHEEMLPPDTHPHRLLSGVARAATQHSTLCQGDTHGADSLAMQTDSEALLNAGLTLARETWEVFSAASAITDWDAAEADRFICHQVGSTHRRKLYETLGIDLARDFSTFETLGNTGSVALPITLATAIEAGAVREGSKVALLGIGSGLNSLMLALQW

SEQ ID NO: 217 - protein, 336 aa, Desulfatibacillum alkenivorans
MKSAIQALAYELPPIRLSSRAIEDQLHSTMERLNMPRKIIEGLTGIRERRLWEPGTLVSDAAARAAQKALDNAGISPRDIGCLISTSVCKDYVEPSVASMVHGALGLPPECLNFDVCNACLGFINGMETVSLMIRSGAIDYGMIINGESSREPIEATIERLKNAETNAEAFRENFATLTLGSGAAAMILCREDLATTGHVINGGVSMAATQHCRLCLGQKDSMVADAPSVMKYGVELAGRTWERAAQGLENWTDETIDAYIPHQVSARNTTVLCRSLGLNQDKMYLNYPLLGNIGPAAIPITLAMAEEVGRVKTGDHVALLGIGSGLNCSMMSLTW

SEQ ID NO: 218 - protein, 349 aa, Shewanella benthica
MKYSRVFINSLAYELAPEVVSTSELESRLAPLYKKFSIPMGQLAALTGITERRWWPKGHRLSDGALAAAHKAIDETGVKVSDLGAVVYTGVCRDQHEPATACRIAAELGVSKDTAIYDISNACLGVLSGILDIANRIELGQIKAGLVVSCESARHIVDITIDNMLADQTMQNYAQSLATLTGGSGAVAVLLTDGSLPLRTDRQHQLLGASHLSAPEHHNLCQWGLQEAGLHLYREFMRTDGVTLLKEGVELARHTWSDFLEQRDWVVEQVDKVICHQVGSANRLKVLNALNIPQEKEFPTYQLLGNMGTVSLPVTAAMAHDQGFLKKGDQVSFLGIGSGLNCMMLGIKW

SEQ ID NO: 219 - protein, 329 aa, Burkholderia oklahomensis
MAQSTLYSRVLGTGSYLPPDRVTNQDLADRLAKDGIETSDEWIVARTGIHARHFAAPDVTTSDLALVAAQRAIEAADVDPQSIDLIIVATSTPDFVFPSTACLLQNKLGIKNNGAAFDVQAVCAGFAYAMTIADTLIRAGQHRTALVVGAETFSRILDFKDRTTCVLFGDGAGAVVLSASEEPGILGSALHADGSYSNILCTPGNVNRGIIAGSAFLHMDGQAVFKLAVNVLEKVAVEALSKADLAPEQVDWLIPHQANIRIMTSTCRKLGLPQERMIVTVDEHGNTSAASIPLALDVAVRDGRVKRGQHVLIEGVGGGFTWGASVFRF

SEQ ID NO: 220 - protein, 329 aa, Burkholderia oklahomensis
MAQSTLYSRVLGTGSYLPPDRVTNQDLADRLAKDGIETSDEWIVARTGIHARHFAAPDVTTSDLALVAAQRAIEAADVDPQSIDLIIVATSTPDFVFPSTACLLQNKLGIKNNGAAFDVQAVCAGFAYAMTIADTLIRAGQHRTALVVGAETFSRILDFKDRTTCVLFGDGAGAVVLSASEEPGILGSALHADGSYSNILCTPGNVNRGIIAGSAFLHMDGQAVFKLAVNVLEKVAVEALSKADFAPEQVDWLIPHQANIRIMTSTCRKLGLPQERMIVTVDEHGNTSAASIPLALDVAVRDGRVKRGQHVLIEGVGGGFTWGASVFRF

SEQ ID NO: 221 - protein, 336 aa, Clostridium botulinum
MRSRIKGVGRYLPNRIVTSEEAEELAGFKKLGVRKGLCKMLTGCEERRYSDTNEYSSHIAAKAAIDVMKKAGVSSDEVDALIFCSVSQDFAEPATANVVMDLLNIKNAFGFDVKNACNAFLTGIDIADSLIKTGKANIVLVVSGEALSKWINFKFESKEELIRRAPVTLSIGDGGGAFIMEREEDDNKGIVKSIFRTYAEYWNNNVVWGGGVRFPRDSDKMYIPGTTKVIIDEQRNLGKNLLPILEREVGWNFQKDVDCYIPTQVAKWINKSMSNELSFPIEKIIQVVDKFGNVGASNIPIATYEAIMDGRLKTGSKTLMSGVGVGINIATIAVIL

SEQ ID NO: 222 - protein, 336 aa, Clostridium botulinum
MRSRIKGVGRYLPSRIVTSEEAEELAGFKKFGVRKGLCKMLTGCEERRYSDTNEYSSHIAAKAAIDAMKKAGVSSDEVDALIFCSVSQDFAEPATANVVMDLLNIKNAFGFDVKNACNAFLTGIDIADSLIKTGKADIVLVVSGEALSKWVNFKFESKEDLIRRAPVTLSIGDGGGAFIMEREKDNNKGIVKGIFRTYAEYWNNNVVWGGGVRFPRDSDKMYIPGTTKVIIDEQRNLGKNLLPILEREVGWNFQKDVDCYIPTQVAKWINKSMSNELSFPIEKIIQVVDKFGNVGASNIPIATYEAIMDGRLKSGSKTLMSGVGVGINIATIALIF

SEQ ID NO: 223 - protein, 385 aa, Gemmata obscuriglobus
MKYNRVHLEAIGYELPPVVVSTAELEARLAPVYKSLNMSPGQLELLTGISERRWWEPGYPLSKGAAAAGRKALAAADISASEIDVLIYAGVCRENFEPATACAVAHELNINPNAAIFDLSNACLGVLNGIVEVANKIELGQAQAGLVVSAETAREINENVIDRMVRTKSVELFRESIATLTGGSGAVAVLVVSAELSREKRRKLLGGATQNAPQYHNLCRWGLQSLLPSAVGTVERVLGANAAGLMQKSVDNATGLVQKGVDLGMRHVMIPFMETHAGEVLKYGVELGHRTWQKFLTKLSWRPDFLDKVICHQVGAGHRDAVLRAIGVSPEKDFSTFEYLGNIGTVSLPITAAIAEEREFLRPGDRVGFLGIGSGLNCLMLGLEW

SEQ ID NO: 224 - protein, 201 aa, Arthrobacter chlorophenolicus
MVGNATFRHTNTALLSVSSVEAPRIVSSVDFDRRLASTLQRLKFPPRLLERVAGITHRRWWAPGTSFDDAAIEAGAKALAEAGVEASEVGLLINTSVTRRNLEPSVAVKIHHGLGLPSSAMNFDLANACLGFVNGLTLAANMIDSGQIKYAVIVNAEDAEATQEATLARLQRPETTREDFNREFATLTLGSGAGRSRPWAR

SEQ ID NO: 225 - protein, 374 aa, Micrococcus luteus
MGAPPDPSDTVGCRLTAGERPPPPTPRRLVLVTNVSGNASYEYSRAALLAVTEVEAPVEVTSRDLDDQLAEVLTRLRLPGSLLERVAGVRSRRNWDETEDFQEAAARAGVAALEQAGVPRERVGLLVNTSVTRATLEPSVAVRIHHLMGLPTSATNFDITNACLGFVNGLMLASTLVDAGQIDYAVVVAAEDASKVQAATVANLHAETTHRGNFMEQFASLTLGSGAAAAVVGRIEDHPDAHRIVRGITRAGTDHHGLCVGDHHGMYTDSTALIKDGLELVMDAWHDVPAEWAWPEADRFITHQVSQMHTDAIAESAHLDPARIPTTFPTLGNVGPASLPITLVREMDTLEDGDTVVCLGVGSGLNTAMLEIEW

SEQ ID NO: 226 - protein, 336 aa, Candidatus Kuenenia stuttgartiensis
MGNEKLNVRQNQITSITGIGSYLPEKILTNHALEKLVDTTDDWILQRTGIRERRIVENGVTTSDLGAIASLKAIENAGISAEEIDMIITSTITPDYLFPSTSCCLQKQIGAVHASAFDISAACAGFVYALSIGQSVINSGAAKTVLVVGAECLSKITDYTDRATCILFGDGAGAVILQNNKEKHQILDTRLVSDGTYTDVLIIPGGGSKHPATIESVQERLHYIRFKGREVFKLAINTITNLVIETAQRNGFAVQDIDLIIPHQSNLRIIEATMERLKLPMEKAFVNIDKYGNTSSASVPIAIDEAQQEGRLKKGDLVMLVAFGGGLTWGSCVVRW

SEQ ID NO: 227 - protein, 320 aa, Neisseria gonorrhoeae
MQYAKISGTGSYLPANRVSNDDLAQKVDTSDEWITARTGIKFRHIAAENEKTSDLAAEAARRALADAKLNINDIDLIIVATATPDMQFPSTATIVQQKLGITNGCPAFDVQAVCAGFMYALTTANAYIKSGMAKNALVIGAETFSRIVDWNDRTTCVLFGDGAGAVVLSASDKPGIIHSKLKADGNYLKLLNVPGQIACGKVSGSPYISMDGPGVFKFAVKMLSKIADDVIEEAGYTAEQIDWIVPHQANRRIIESTAKHLGLSMDKVVLTVQDHGNTSAASIPLALDAGIRSGQIKRGQNLLLEGIGGGFAWGAVLLQY

SEQ ID NO: 228 - protein, 332 aa, Saccharophagus degradans
MEMNCISKIAGIGAYLPKQRVTSDELMAEIASTRFGTPENYISNKIGIIERRMADEKTLASDMAIMASEVALRDANVQAHEIDLILYCGIERDWQEPATAHRIQAELGATSAIVLDVTNACHGFLNGISIADAFIANHSAQTVLVCTGEKQSNLTYEAIDQLKKLSSKEEFRKRLGGLTVGDAGGAMIIQRGNEHSGFQKMNFMSDGSHTNLCYYKHTDSGTQGQMLMREITVQILRLHKMFIDSTYELLGWQPESIDKLFCHQTGAKPHQGMASLAHQPINKAPITYDNYGNLTSASIPVNMFLNRPQRGEKILIMGTGSGLSVCQSGLIF

SEQ ID NO: 229 - protein, 338 aa, Xylella fastidiosa; identical to SEQ ID NO: 163

SEQ ID NO: 230 - protein, 295 aa, Rhodococcus
IGTGFPFDPHYVEVLGERMHYVDVGPRDGTPVLFLHGNPTSSYLWRNIIPHVAPSHRCIAPDLIGMGKSDKPDLDYFFDDHVRYLDAFIEALGLEEVVLVIHDWGSALGFHWAKRNPERVKGIACMEFIRPIPTWDEWPEFARETFQAFRTADVGRELIIDQNAFIEGVLPKCVVRPLTEVEMDHYREPFLKPVDREPLWRFPNEIPIAGEPANIVALVEAYMNWLHQSPVPKLLFWGTPGVLIPPAEAARLAESLPNCKTVDIGPGLHYLQEDNPDLIGSEIARWLPGLASGLG

SEQ ID NO: 231 - protein, 296 aa, Artificial Sequence
  Expression vector pHT2
MGSEIGTGFPFDPHYVEVLGERMHYVDVGPRDGTPVLFLHGNPTSSYLWRNIIPHVAPSHRCIAPDLIGMGKSDKPDLDYFFDDHVRYLDAFIEALGLEEVVLVIHDWGSALGFHWAKRNPERVKGIACMEFIRPIPTWDEWPEFARETFQAFRTADVGRELIIDQNAFIEGALPMGVVRPLTEVEMDHYREPFLKPVDREPLWRFPNELPIAGEPANIVALVEAYMNWLHQSPVPKLLFWGTPGVLIPPAEAARLAESLPNCKTVDIGPGLFLLQEDNPDLIGSEIARWLPGLAG

SEQ ID NO: 232 - protein, 297 aa, Mycobacterium marinum
MDVVRTPDARFQNLVGYPFAAHYVDVAATDTPHLRMHYIDEGPADGPPIVLLHGEPTWSYLYRTMIPPLAAGGYRVLAPDLIGFGRSDKPTRIADYTYLRHVEWVKSWFEELRLAEATLFVQDWGSLIGLRVAAEHGDAIARLVVANGFLPTARGRTPTAFHIWRAFARYSPVLPAGRLVAAGTVRKVPPAVRAGYDAPFPDKSYQAGARAFPQLVPISPDDPAVAANRAAWDALGRWEKPFLAIFGERDPLLGRADRPLIKHIPGAAGQPHARINANHFIQEDSGPELAERIISWQ

SEQ ID NO: 233 - protein, 290 aa, Mycobacterium marinum
MKRVDVLDSAMSYIDVGQGDPIVFLHGNPTSSYLWRNVIPHLSDVGRCLAPDLIGMGASGTSPTFSYRFADHVRYLDAWFEAVGITENVVLVVHDWGSALGFYRALRYPEQIAGIAYMDALVQPRTWAGFTDYEPLMRALRTEQGERMALAENVFVEKVVPGGVQRQLTEEEMAVYRTPYPTPQSRIPTLLWAREIPVEGEPADVQAMVQEYADFLSRSDIPKLLIVAEPGAILHEGGSELDFARSWPNQREVKVAGRHFLQEDSPDAIGAAVRAFVLDVRERQDGADRA

SEQ ID NO: 234 - protein, 314 aa, Streptomyces ambofaciens
MVTARAGHAPAPDRAALERLMPGYPAPRHWRRVPVTGQHYLDLGSGRPVLFLHGNPSWSYVWRKLLHRLAPHARCLAPDLPGFGLSRRLRPADGVPDPYEAQLEGLDSLHRHLVRNEGLPERGWTFVLHDWGGPLGTAWALRNPGVVARLVVCNTVAFPFPEGFRLPFYLRWIRDHRPVATFVHATNAFARVAVRAGVHHPMLPAERRAYLRPYARRAERRAVTDAVRAIPRGPADPVWHLLEPPGAVAGLADLPLLVGWGMRDPVFTPDLLQEWARLYPQAVIHRFPDAGHFVMEDAAAELSDHIRDFLQGAP

SEQ ID NO: 235 - protein, 361 aa, Unknown
  Uncultured Marine Microorganism
MNRLLPLTLSAVLAAATQAAAQPVSNAAGAAALTAPLHSQTQTRSGDKPMSQAIPAVAPEETFDGTWPFRARYTDAPGFRMHYIDEGSGPETLLLLHGEPTWSYLFRQQIPVWAARHRVIAVDHMGFGKSAAPQDRTYWLQDHIDNLERFVFALNLRDITLVMHDFGGPVGMGLAIRHPDRIKRIVSVEGPTPAGQPDLMERLSANGAISPWFQWIFKAEKEGVLEQVLGQLDYNILSTLKLNGFERNEIITDTWLRAYRAPFPTPAHAAGGIGWAKGFATGAHQFEQPDAATKAELAKKPALAIWGEADLTLHAKHFLPLFSQTFPNGQVHRLPGVGHYSPEDAPETVARLVAEFVEANR

SEQ ID NO: 236 - protein, 300 aa, Xanthomonas campestris
MTYPGYSFTPKRLDVRPGIAMSYLDEGPRDGEVVVMLHGNPSWSYLWRHLVSGLSDRYRCIVPDHIGMGLSDKPDDAPDAQPRYDYTLQSRVDDLDRLLQHLGITGPITLAVHDWGGMIGFGWALSHHEQVKRLVITNTAAFPLPPEKPMPWQIAMGRHWRLGEWFIRTFNAFSSGASWLGVSRRMPAAVRRAYVAPYDSWKNRISTIRFMQDIPLSPADQAWSLLERSAQALPSFAGRPAFIAWGLRDICFDKHFLAGFRRALPQAEVMAFDDANHYVLEDKHEVLVPAIRAFLERNPL

SEQ ID NO: 237 - protein, 309 aa, Mycobacterium tuberculosis
MAQLREEQIMDVLRTPDSRFEHLVGYPFAPHYVDVTAGDTQPLRMHYVDEGPGDGPPIVLLHGEPTWSYLYRTMIPPLSAAGHRVLAPDLIGFGRSDKPTRIEDYTYLRHVEWVTSWFENLDLHDVTLFVQDWGSLIGLRIAAEHGDRIARLVVANGFLPAAQGRTPLPFYVWRAFARYSPVLPAGRLVNFGTVHRVPAGVRAGYDAPFPDKTYQAGARAFPRLVPTSPDDPAVPANRAAWEALGRWDKPFLAIFGYRDPILGQAGGPLIKHIPGAAGQPHARIKASHFIQEDSGTELAERMLSWQQAT

SEQ ID NO: 238 - protein, 300 aa, Mycobacterium tuberculosis
MDVLRTPDSRFEHLVGYPFAPHYVDVTAGDTQPLRMHYVDEGPGDGPPIVLLHGEPTWSYLYRTMIPPLSAAGHRVLAPDLIGFGRSDKPTRIEDYTYLRHVEWVTSWFENLDLHDVTLFVQDWGSLIGLRIAAEHGDRIARLVVANGFLPAAQGRTPLPFYVWRAFARYSPVLPAGRLVNFGTVHRVPAGVRAGYDAPFPDKTYQAGARAFPRLVPTSPDDPAVPANRAAWEALGRWDKPFLAIFGYRDPILGQADGPLIKHIPGAAGQPHARIKASHFIQEDSGTELAERMLSWQQAT

SEQ ID NO: 239 - protein, 301 aa, Xylella fastidiosa
MSYHDYPFLSQCFEVRPGIRMRYLDEGPRDAAVVVMLHGNPSWSYYWRHLVAALRDGYRCIVPDHIGMGLSDKPGDAPGVVPRYDYTLQSRVDDLDALLRHVGIDDVTPLTLAVHDWGGMIGFGWALAHAVQVRRLVMTNTAVFPMPTSKKMPWQIALGRDWRFGEWMVRGLNAFALGAAWLGVETRLPRAVRRAYLAPYNSWANRISIIRFMQDIPCGPGDRAWPLLEATGKALPDFADRPVFIGWGMQDIVFDHHCLDEFRAALPGAQVQVFADAGHYVLEDKSSVLVPAIRAFLDAHP

SEQ ID NO: 240 - protein, 300 aa, Xanthomonas campestris
MTYPGYSFTPKRLDVRPGIAMSYLDEGPSDGEVVVMLHGNPSWGYLWRHLVSGLSDRYRCIVPDHIGMGLSDKPDDAPDAQPRYDYTLQSRVDDLDRLLQHLGITGPITLAVHDWGGMIGFGWALSHHAQVKRLVITNTAAFPLPPEKPMPWQIAMGRHWRLGEWFIRTFNAFSSGASWLGVSRRMPAAVRRAYVAPYDNWKNRISTIRFMQDIPLSPADQAWSLLERSAQALPSFADRPAFIAWGLRDICFDKHFLAGFRRALPQAEVMAFDDANHYVLEDKHEVLVPAIRAFLERNPL

SEQ ID NO: 241 - protein, 300 aa, Xanthomonas axonopodis
MNYPGYPFPPKRLEVRPGVAMSYLDEGPRDGEVVVMLHGNPSWSYLWRHLVSGLSDRYRCIVPDHIGMGLSDKPDDAPDAQPRYDYTLQSRVDDLDTLLRHLGITGPVTLAVHDWGGMIGFGWALSHHAQVKRLVITNTAAFPLPAEKPMPWQIAMGRHWRPGEWFIRTFNAFSSGASWFGVSRRMPADVRRAYVAPYNNWRNRISTIRFMQDIPLSPADQGWSLLERSAQALPAFADRPAFIAWGLRDICFDKHFLAGFRRALPQAEVTAFNDANHYVLEDKHEVLVPAIRAFLERNPL

SEQ ID NO: 242 - protein, 318 aa, Shewanella oneidensis
MLDTLLPFKRHFLSRNGNKLHYINEGQGEPVVMVHGNPSWSFYYRNLVSALKDTHQCIVPDHIGCGLSDKPDDSGYDYTLKNRIDDLEALLDSLNVKENITLVVHDWGGMIGMGYAARYPERIKRLVILNTGAFHLPDTKPLPLALWICRNTLLGTVLVRGFNAFSSIASYVGVKRQPMSKYIREAYVAPFNSWANRISTLRFVQDIPLKPGDRNYQLVSDIAASLPKFAKVPTLICWGLQDFVFDKHFLVKWREHMPHAQVHEFADCGHYILEDASDEVITHIKHFMTETETLATQVNPADSITEFESASQAPQAER

SEQ ID NO: 243 - protein, 301 aa, Xylella fastidiosa Temecula1
MSYHDYPFLSQCFEVRPGIRMRYLDEGPRDAAVVVMLHGNPSWSYYWRHLVAALRDGYRCIVPDHIGMGLSDKPGDAPGVVPRYDYTLQSRVDDLDALLRHVGIDDVTPLTLAVHDWGGMIGFGWALAHAVQVRRLVITNTAVFPMPMSKKMPWQIALGRDWRFGEWMVRGLNAFALGAAWLGVETRLPRAVRRAYLAPYNSWANRISIIRFMQDIPCAPGDRAWPLLEATGKALPNFADRPAFIGWGMQDIVFDHHFLDEFCAALPGAQVQVFDDAGHYVLEDKSSVLVPAIRAFLDAHP

SEQ ID NO: 244 - protein, 328 aa, Rhodopirellula baltica
MSCRLSSNRRGSSKLAAMTNLASDLFPHPSSELSIDGHTLRYIDTAASSDIPSSAVGSSDGEPTFLCVHGNPTWSFYYRRIIERYGKQQRVIAVDHIGCGRSDKPSEDEFPYTMAAHRDNLIRLVDELDLKNVILIAHDWGGAIGLSAMHARRDRLAGIGLLNTAAFPPPYMPQRIAACRMPVLGTPAVRGLNLFARAAVTMAMSRTKMKPDVAAGLLAPYDNWKNRVAIDRFVRDIPLNDSHPTMKTLRQLESDLPDLASLPISLIWGMKDWCFRPECLRRFQSVWPDAEVTELATTGHYVIEDSPEETLAAIDSLLARVKERIGAA

SEQ ID NO: 245 - protein, 301 aa, Mycobacterium avium
MHVLRTPDSRFENLEDYPFVAHYLDVTARDTRPLRMHYLDEGPIDGPPIVLLHGEPTWSYLYRTMITPLTDAGNRVLAPDLIGFGRSDKPSRIEDYSYQRHVDWVVSWFEHLNLSDVTLFVQDWGSLIGLRIAAEQPDRVGRLVVANGFLPTAQRRTPPAFYAWRAFARYSPVLPAGRIVSVGTVRRVSSKVRAGYDAPFPDKTYQAGARAFPQLVPTSPADPAIPANRKAWEALGRWEKPFLAIFGARDPILGHADSPLIKHIPGAAGQPHARINASHFIQEDRGPELAERILSWQQALL

SEQ ID NO: 246 - protein, 293 aa, Rhodococcus rhodochrous
MSEIGTGFPFDPHYVEVLGERMHYVDVGPRDGTPVLFLHGNPTSSYLWRNIIPHVAPSHRCIAPDLIGMGKSDKPDLDYFFDDHVRYLDAFIEALGLEEVVLVIHDWGSALGFHWAKRNPERVKGIACMEFIRPIPTWDEWPEFARETFQAFRTADVGRELIIDQNAFIEGALPKCVVRPLTEVEMDHYREPFLKPVDREPLWRFPNELPIAGEPANIVALVEAYMNWLHQSPVPKLLFWGTPGVLIPPAEAARLAESLPNCKTVDIGPGLHYLQEDNPDLIGSEIARWLPAL

SEQ ID NO: 247 - protein, 294 aa, Rhodococcus sp. TDTM0003
MSEIGTGFPFDPHYVEVLGERMHYVDVGPRDGTPVLFLHGNPTSSYLWRNIIPHVAPSHRCIAPDLIGMGKSDKPDLDYFFDDHVRYLDAFIEALGLEEVVLVIHDWGSALGFHWAKRNPERVKGIACMEFIRPIPTWDEWPEFARETFQAFRTADVGRELIIDQNAFIEGVLPKCVVRPLTEVEMDHYREPFLKPVDREPLWRFPNEIPIAGEPANIVALVEAYMNWLHQSPVPKLLFWGTPGVLIPPAEAARLAESLPNCKTVDIGPGLHYLQEDNPDLIGSEIARWLPGLA

SEQ ID NO: 248 - protein, 307 aa, Mycobacterium sp. GP1
MSEIGTGFPFDPHYVEVLGERMHYVDVGPRDGTPVLFLHGNPTSSYLWRNIIPHVAPSHRCIAPDLIGMGKSDKPDLDYFFDDHVRYLDAFIEALGLEEVVLVIHDWGSALGFHWAKRNPERVKGIACMEFIRPIPTWDEWPEFARETFQAFRTADVGRELIIDQNAFIEGALPKFVVRPLTEVEMDHYREPFLKPVDREPLWRFPNELPIAGEPANIVALVEAYMNWLHQSPVPKLLFWGTPGVLISPAEAARLAESLPNCKTVDIGPGLHFLQEDNPDLIGSEIARWLPALIVGKSIEFDGGWAT

SEQ ID NO: 249 - protein, 288 aa, Desulfotalea psychrophila
MFTEYPFQSNYFEIGGQRLHYVDEGHGPVIVLVHGNPTWSFYYRRVISLLSKTHRIIAVDHMGCGLSDKPQDYSYTLQTHRQNLFQLLEHLQIEKYSLVVHDWGGAIGVGCAAFAPERVEKLVVLNTAAFRSTHIPLRISLCRAPLFGEYLVRGLNGFAWPASFMAVQKRLSKEVVAGYLAPYSNWEKRVAVYGFVHDIPLNSAHPSYGTLVEVERGLEALVARQVPTLILWGGKDFCFNDHFYRQWCERVPYAEKVYYENGGHYILEDEFADIAPRLERFFTVCEED

SEQ ID NO: 250 - protein, 303 aa, Photobacterium profundum
MLDTLFPFKRNFLSRNGHKLHYVNEGQGEPVVMVHGNPSWSFYYRNLVTELSQNHQCIVPDHIGCGLSDKPDDAGYDYTLKNRIDDLEALLEHLEVRENITLVVHDWGGMIGMGYAARYPDRIKRLVILNTGAFHLPDTKPFPWALWICRNTLLGTGLVRGFNAFSSIASYIGVKRKPMSPEVRKAYVSPFNSWANRISTLRFVQDIPLRKGDRNYELVSEIAASLPKFSHVPTLICFGLKDFVFDKHFLAVWREKMPHATVHEFEDCGHYILEDASDEVVPLISDFMKMPLATDNKPSEADL

SEQ ID NO: 251 - protein, 300 aa, Xanthomonas oryzae
MNYPGYPFTPKRFEVRPGVAMSYLDEGPRDGEVVVMLHGNPSWSYLWRHLVRGLCDRYRCIVPDHIGMGLSDKPDDAPDAQPRYDYTLQSRVDDLDTLLRHLGITGPVTLAVHDWGGMIGFGWALSHHAQVKRLVITNTAAFPLPAEKPMPWQIAMGRHWRLGEWFIRTFNAFSSGASWFGVSRRMPAAVRRAYVAPYNTWRNRISTIRFMQDIPLSPADKGWSLLERSAQALPTFAERPAFIAWGLRDICFDKHFLAGFRKALPHAEVTAFDDANHYVLEDKHEVLVPAIRAFLERHPL

SEQ ID NO: 252 - protein, 308 aa, Colwellia psychrerythraea
MSDTMSKSMLENKLTKLFPFTRNFINRNGHQYHYVNEGQGSPVVMVHGNPSWSFYYRNLVSQLSKSHQCIVPDHIGCGLSDKPDDDGYDYTLANRIDDLEALLEHLDVKENITLVVHDWGGMIGMGYAARHPERIKRLVILNTGAFHLPKAKKLPPALWLGRNTFVGAALVRGFNAFSSVASYIGVKRKPMSKEVREAYVAPFNSWTNRISTLRFIQDIPLKIGDRNYQLVSDISDNLAQFKKIPMLICWGLKDFVFDRHFLDEWQHRFPDAQVHAFDDCGHYILEDASDEVVPLIENFLKTSETKLA

SEQ ID NO: 253 - protein, 300 aa, Xanthomonas campestris
MNYPGYPFTPKRLEVRPGVAMSYLDEGPRDGEVVVMLHGNPSWSYLWRHLVSGLSDRYRCIVPDHIGMGLSDKPDDAPDAQPRYDYTLQSRVDDLDTLLRHLGITGPVTLAVHDWGGMIGFGWALSHHAQVKRLVITNTAAFPLPAEKPMPWQIAMGRHWRLGEWFIRTFNAFSSGASWLGVSRPMPSDVRRAYVAPYNNWRNRISTIRFMQDIPLSPADKGWSLLERSAQALPSFADRPAFIAWGLRDICFDKHFLAGFRKALPQAEVTAFDDANHYVLEDKHEVLVPAIRAFLERNPL

SEQ ID NO: 254 - protein, 307 aa, Burkholderia sp. 383
MIRSDATFDGTFPFAPHFDDASGFRMHYVDEGPHDGETILCLHGEPTWGYLFRHLIAALSPTHRVVVPDHMGFGKSATPQDRSYWLQDHIDNLERFVLARGLDRITLVLHDFGGPVGMGLAARHPDRIRRIVSANGPTPFGQPDLADRLNANGRDAPWFQWIMRAAADDTLETVLGQLGFNILSTLKLNGFENHAIINDTWIAAYGAPFAQPKDCVGAIGWARGFAAGAHRFEEPDAAALRAIREKPALAIWGDADRTLGAEHFLPLFTALFPSAPVERLAGVGHYCFEDAPDAIAARIAEFIRTTG

SEQ ID NO: 255 - protein, 301 aa, Hahella chejuensis
MDDQWINREEYPFASHYIELGPGRMHYVDEGQGKPIVMLHGNPTWSFLYRNMIKGLSGQFRCIAPDHLGFGLSDKPGDWSYLPQDHARNLEILIKKLNLQDITLVVQDWGGPIGLSYALNHPQNVRRLVIMNTWMWSAHGDVKYETFSTLMGGLFGRFMIKRFNVFVSVLLKQAVQKKLSADIYRHYSEPLKNPAERKGCWVFPKQIIKADEWLEELWEKRANIADIPTLLLWGMKDFAFQERELRTWMQLLNHHTAVTFDDAGHFLPEDKGVEVCPLIADFLQDAEPTFQREASAPAPVV

SEQ ID NO: 256 - protein, 314 aa, Jannaschia sp. CCS1
MTGVFDAAHGRAQATVARLGIGAEYRFAHHFAHTPMGTMHYVDEGTGDPVLLLHGNPTWSYLYRKFIPALAQTHRVIAPDHIGFGLSDKPEAEGDYTLDAHIQNLEALVQQLDLTNITLVMQDWGGPIGLGMAARHPARIKALVVMKTFGFYPPIDGVDPDKLKLPPPLLMMRAKGIGDFLVRRLGFFERQVMTMATATKRKGPSKRAYRDIFRTYAERAGVMAFPRMIPANTGHPAAQILMQETGPYIDQFDGPAHIFWGMKDPLIPVGALTAWKKRLPQAGVTEFATARHYLQDDVPDQLIPELVEFLNRDV

SEQ ID NO: 257 - protein, 297 aa, Shewanella denitrificans
MLDTLLPFKSHFLSRNGQQLHYLNEGEGEAVVMVHGNPSWSYYYRNLVAELKGEYQCIVPDHIGCGLSDKPDDPQYDYTLKSRIDDLEALLEHVEVRENITLVLHDWGGMIGMGFAARHPERIKRLVLLNTAAFHLPQSKPFPWALWICRETFLGTLLVRGFNAFSAAASYVGVKRKPMDNAVREAYVAPFNSWTNRISTLRFVQDIPLKPSDRNYQLVSDIADSLSQFKQTPALICFGMQDFVFDKHFLQEWRRRLPNAKVHEFADCGHYILEDAPDEVIGLVKDFLTGTESEKTH

SEQ ID NO: 258 - protein, 307 aa, Burkholderia cenocepacia
MIRSDATFDGTFPFAPHFDDASGFRMHYVDEGPRDGEIVLCLHGEPTWGYLFRHLVTALSPTYRVVVPDHMGFGKSATPQDRSYWLQDHIDNLERFVLAHDLDRITLVMHDFGGPVGMGLAARHPDRIRRIVSANGPTPFGQTDLAERLTANGREAPWFQWIMRAAADGTLETVLGQLGFNILSTLKLNGFENHAIIADTWIAAYGAPFAQPADCLGAIGWARGFAAGAHRFEEPDAAALRAIRGKPALAIWGDADRTLGTEHFLPLFTALFPSAPIERLAGVGHYCFEDAPDAIAARIADFIRTTG

SEQ ID NO: 259 - protein, 306 aa, Pseudoalteromonas atlantica
MQYLRTSDDCFEGLSGYSFAPHYIEVDDFEGGNLRMHYLDEGSKEGEVVLMLHGEPSWSYLYRDMIKPIADKGYRVIAPDLIGFGRSDKPTQRCDYTYQRHLDWIRNILTQLNLKQVTLVCQDWGGLLGLRLVAEHPELFARVLAANTMLPTGDHPPGEAFMKWRAFSQEVPEFPVAGIIKGATVTALSTDVLNAYDAPFPTEAHKAGVRQFPLLVPATTDDPQTQNNRKAWQVLQQFNKPFITAFSDSDPVTAGGDKIMQKLIPGTQGQSHTTITQGGHFLQEDQPQQLAKVLLQFINDNPISTD

SEQ ID NO: 260 - protein, 339 aa, Shewanella sp. MR-4
MSRNLPPIQKQLEQKIGSVMLDTLLPFKRHFLSRNGNKLHYINEGQGEPVVMVHGNPSWSFYYRNLVSALKDTHQCIVPDHIGCGLSDKPDDSGYDYTLKNRIDDLEALLDSLKVNENITLVVHDWGGMIGMGYAARYPERIKRLVILNTGAFHLPDTKPLPLALWICRNTLLGTVLVRGFNAFSSIASYVGVKRQPMSKYIREAYVAPFNSWANRISTLRFVQDIPLKPGDRNYQLVSDIAASLPKFAKVPTLICWGLQDFVFDKHFLAKWREHMPHAQVHEFADCGHYILEDASDEVITHIKHFMAEAQTPEPEVQQVETESVTEPEVETQAPQAAH

SEQ ID NO: 261 - protein, 339 aa, Shewanella sp. MR-7
MSRNLPPIQKQLEQKIGSVMLDTLLPFKRHFLSRNGNKLHYINEGQGEPVVMVHGNPSWSFYYRNLVSALKDTHQCIVPDHIGCGLSDKPDDSGYDYTLKNRIDDLEALLDSLKVNENITLVVHDWGGMIGMGYAARYPERIKRLVILNTGAFHLPDTKPLPLALWICRNTLLGTVLVRGFNAFSSIASYVGVKRQPMSKYIREAYVAPFNSWANRISTLRFVQDIPLKPGDRNYQLVSDIAASLPKFAKVPTLICWGLQDFVFDKHFLAKWREHMPHAQVHEFADCGHYILEDASDEVITHIKHFMAEVQTPEPEVQHVETAQVTEPEAETQAPQAAH

SEQ ID NO: 262 - protein, 291 aa, Shewanella frigidimarina
MLDNLLPFKSHYLDRNGNKLHYINEGQGEPVVMVHGNPSWSYYYRNLVSALSDKHQCIVPDHIGCGLSDKPDDPQYDYTLKNRIDDLEALLDSLDVKQNITLVVHDWGGMIGMGFAARHPERIKRIVCLNTAAFHLPKTKPFPWALWICRETLLGTLLVRGLNAFSSAASYVGVKRKPMSKEVREAYVAPFDSWKNRISTLRFVQDIPLKPGDRNYDLVTSIGDSLSEFAEVPTLICFGLQDFVFDKYFLEEWRQRMPHATVHEFADCGHYILEDASDEVIGLIKDFIAKN

SEQ ID NO: 263 - protein, 320 aa, Shewanella sp. ANA-3
MLDTLLPFKRHFLSRNGNKLHYINEGQGEPVVMVHGNPSWSFYYRNLVSALKDTHQCIVPDHIGCGLSDKPDDSGYDYTLKNRIDDLEALLDSLKVKENITLVVHDWGGMIGMGYAARYPERIKRLVILNTGAFHLPETKPLPLALWICRNTLLGTVLVRGFNAFSSIASYVGVKRQPMSKYIREAYVAPFNSWANRISTLRFVQDIPLKPGDRNYQLVSDIAASLPKFAKVPTLICWGLQDFVFDKHFLAKWREHMPHAQVHEFADCGHYILEDASDEVITHIKHFMAEAQTPEPEVQPVETEQVAEPEAETQAPQAAH

SEQ ID NO: 264 - protein, 310 aa, Mycobacterium avium
MPVHAEELNMHVLRTPDSRFENLEDYPFVAHYLDVTARDTRPLRMHYLDEGPIDGPPIVLLHGEPTWSYLYRTMITPLTDAGNRVLAPDLIGFGRSDKPSRIEDYSYQRHVDWVVSWFEHLNLSDVTLFVQDWGSLIGLRIAAEQPDRVGRLVVANGFLPTAQRRTPPAFYAWRAFARYSPVLPAGRIVSVGTVRRVSSKVRAGYDAPFPDKTYQAGARAFPQLVPTSPADPAIPANRKAWEALGRWEKPFLAIFGARDPILGHADSPLIKHIPGAAGQPHARINASHFIQEDRGPELAERILSWQQALL

SEQ ID NO: 265 - protein, 296 aa, Pelobacter propionicus
MVSDPLKRHYPFQSHHLDLDGLAYHYLDEGSGPAVVMLHGNPSWSFYYRNLVRELSASYRCIVPDHIGCGLSDKPGDERYDYTLARRVQDLERLLDHLAIRDNITLVVHDWGGMIGMAYAVAHPRAIRRLVVMNTAAFQLPPGKPFPLALRICRDTRLGSLLVRGFNAFSLAASFVGCKRNPLSRELRRLYRLPYGSWNDRIATLRFVQDIPLKPGDRGFDLVNSVDRGLDQFRDLPLLLVWGERDFVFDRHFLAEWRRRFPQAEVHSYADAGHYILEDMKDEVVPIISAFLKRTE

SEQ ID NO: 266 - protein, 310 aa, Shewanella amazonensis
MDNHKMLDSLLPFKRRFFNHGGHNIHFIDEGPEGDVAPKGTVVMVHGNPSWTLYYRNLIRALKGEYRCIAMDNVGCGLSDKPDDSRYHYTLTSRIGDLEALLASLNVTEKVTLVVHDWGGMIGMGWATKYPDAIERLVILNTAAFHLPATKPLPLRLKICRDTWLGTLLVRGFNAFAGLASVIGCKRNPMNAEMRRAYVAPFNSWANRISTLRFVQDIPLKPGDTAWDEVSRIEQSLAQFTRVPTLICWGLKDFVFDRHFLTVWQEKLPQAEVHAFEDCGHYILEDASDEVIAHIERFVAASAPAEALAS

SEQ ID NO: 267 - protein, 293 aa, Psychromonas ingrahamii
MNLDTLFPFKRNYLDRNGQQYHYLNEGSGEPVVMVHGNPSWSFYYRNLVKSLSRNYQCVVPDHIGCGLSDKPADKDYQYTLKNRIDDLEALLDSLNINENITLVVHDWGGMIGMGYAARHPERIKRLVILNTAAFHLPSTKSFPVPLLIGRNTYIGTVLIRGLNAFSAIASYVGVKRKPMEKAVRQAYVAPFNSWKNRISTLRFVQDIPLLPHHKNYQLVSDISDSLIHFQKIPTIICWGMKDFVFDKHFLNTWKEKMPHAVVHEFDDCGHYILEDASEQVIPLIETFMAENP

SEQ ID NO: 268 - protein, 298 aa, Mycobacterium vanbaalenii
MDILRTPDERFADLPDFPFAPHYVEVDGLRMHYLDEGPADGPVVLLLHGEPSWSYLYRRMIPVLVDAGLRAVAIDLVGFGRSDKPTRREDYTYQAHVDWTWAAIEAIGLTGITLVCQDWGGLIGLRLVGEHPDRFARVVAANTTLPTGDQRPGEAFLAWQRFSQETPDFAVGHIVNGGCVSTLAPEVIAAYDAPFPDDSYKAGARQFPTLVPTSPDDPAAPANRAAWEVLRTFDRPFLCAFSDSDPITRGADAPLRKFIPGAQGRPEVTIAGGGHFLQEDKGPELAAVVVDFIAANPV

SEQ ID NO: 269 - protein, 299 aa, Marinobacter aquaeolei
MRILRTDEARFAGLPDYPFSAHYLDVEPGLRMHYVDEGPAHAAPVVMLHGEPSWSYLYRHMIPLVAEAGHRVLAPDLIGFGKSDKPADVSNYSYDSHMNWLTHWLETLDLTNVTLVCQNWGSLLGLRLAAEHHRRFSRIIVGNGMLPTGDNRVPVVFRLWKAFASHSPWFPIGRIVQLGTERSLSPAEIAAYEAPFPTPDYKAGARAFPALVPTSPNDPASAANREAWRVLEKWRKPFITCFSSGDPITRGGDRYMQRRIPGAFGQPHITLNGGHFLQEDSPRQFARVILDALKAEMAA

SEQ ID NO: 270 - protein, 303 aa, Shewanella sp. W3-18-1
MLDTLLPFQRHFFNRNGNKLHYINEGHGEPVVMVHGNPSWSFYYRNLVSALKDSHQCIVPDHIGCGLSDKPDDSGYDYTLKRRIDDLEALLDSLNIKENITLVVHDWGGMIGMGYAARYPERIKRLVILNTGAFHLPESKPFPWPLWICRNTLLGTVLVRGFNAFSSIASYVGVKRQPMAKYIREAYVAPFNSWSNRISTLRFVQDIPLREGDRNYQLVSDIAASLPKFAKVPTLICWGLKDFVFDKHFLAKWRQHMPHATVHEFADCGHYILEDASDEVIAHIKGFMADEQVASASAERAAG

SEQ ID NO: 271 - protein, 302 aa, Shewanella baltica
MLDTLLPFKRHFLSRNGNKLHYINEGQGEPVVMVHGNPSWSFYYRNLVSALKDTHQCIVPDHIGCGLSDKPDDSGYDYTLKNRIDDLEALLDSLNVKENITLVVHDWGGMIGMGYAARYPERIKRLVILNTGAFHLPETKPFPWPLWICRNTLLGTVLVRGFNAFSSIASYVGVKRQPMSKYIREAYVAPFNSWANRISTLRFVQDIPLREDDRNYQLVSDIAASLPQFAKVPTLICWGLKDFVFDKHFLAKWRQHMPHAAVHEFADCGHYILEDASDEVIAHIKGFMADDQAAAPSEQAAG

SEQ ID NO: 272 - protein, 290 aa, Shewanella loihica
MLDSLFPIKRNYLDRNGHKLQYVNEGQGEPVVMVHGNPSWSFYYRNLVTALSPNHQCIVPDHIGCGLSDKPDDAGYDYTLKNRIDDLEALLDHLEVKEKITLIVHDWGGMIGMGYAARHPERIKKIVVLNTGAFHLPEAKPFPWALWICRNTLLGTVLVRGFNAFSSIASYVGVKRAPMPKAIREAYVAPFNSWANRISTLRFVQDIPLKPGDRNYELVSEISEKLNQFNQLPMMICWGLKDFVFDKHFLDEWKRRFPEAEVHEFADCGHYILEDASDEVVAQVQQFMAR

SEQ ID NO: 273 - protein, 303 aa, Shewanella putrefaciens
MLDTLLPFQRHFFNRNGNKLHYINEGHGEPVVMVHGNPSWSFYYRNLVSALKDSHQCIVPDHIGCGLSDKPDDSGYDYTLKRRIDDLEALLDSLNIKENITLVVHDWGGMIGMGYAARYPERIKRLVILNTGAFHLPESKPFPWPLWICRNTLLGTVLVRGFNAFSSIASYVGVKRQPMAKYIREAYVAPFNSWSNRISTLRFVQDIPLREGDRNYQLVSDIAASLLKFAKVPTLICWGLKDFVFDKHFLAKWRQHMPHATVHEFADCGHYILEDASDEVIAHIKGFMADEQVASASSERAAG

SEQ ID NO: 274 - protein, 294 aa, Geobacter uraniireducens
MSIDIKKYYPFTGHNLNLDGLRYHYLDEGSGEPVVMVHGNPSWSFYYRNLVLALRDRYRCIVPDHIGCGFSDKPGDDRYDYTLSRRVDDLERLLDSLGISKNITLVLHDWGGMIGMAYAVRHPKRIKRLVILNTAAFHLPKEKPFPLALKICRDTRLGALLVRGFNAFSLAASFVGCKKNPMSAELRQAYRRPYDTWQNRIATIRFVQDIPLSPGDRNYNLVSEVAAGIDRFRNLPMAVFWGEQDFVFDCSFLAEWQRRFPEAEVHRYSDAGHYILEDMKEEVVPLIGEFLDRT

SEQ ID NO: 275 - protein, 302 aa, Shewanella baltica
MLDTLLPFKRHFLSRNGNKLHYINEGQGEPVVMVHGNPSWSFYYRNLVSALKDTHQCIVPDHIGCGLSDKPDDSGYDYTLKNRIDDLEALLDSLNVKENITLVVHDWGGMIGMGYAARYPERIKRLVILNTGAFHLPETKPFPWPLWICRNTLLGTVLVRGFNAFSSIASYVGVKRQPMSKYIREAYVAPFNSWANRISTLRFVQDIPLREGDRNYQLVSDIAASLPQFAKVPTLICWGLKDFVFDKHFLAKWRQHMPHATVHEFADCGHYILEDASDEVIAHIKGFMADDQAAAPSEQAVG

SEQ ID NO: 276 - protein, 304 aa, Anaeromyxobacter sp. Fw109-5
MERLPAPPLPPFLARALPFERSVVVAGGLALHVMESGPAAAPTVVLLHGNPTWSFLWREVALRLRDAPLRLVMPDLPGLGLSEKPRDPRFHTLERHARVMGALLDAAAPGRFVLAVHDWGGPIALAALADRPGRLAGLVVTNTGVGPPRPGARKTAFHRLANLPVLSTILFRLLGFPQNALHLAQADRRSIRGDVARAYRWPLRRLRDRAAPLALARMVPLSPGHPSMPFLERALGVATAFDGPAAVVWGERDPVLGRALRGVASALPAARVTRLPAGHTPQEEAPGPIADAIRDVARRAGFLR

SEQ ID NO: 277 - protein, 295 aa, Shewanella sediminis
MLDTLFPFKRNYLDRNGNKLQYVNEGQGEPVVMVHGNPSWSFYYRNVVTALSGNHQCIVPDHIGCGLSDKPDDSGYDYTLKNRIDDLEALLEHLGVRENITLIVHDWGGMIGMGYAARYPERIKRLVVLNTGAFHLPSSKPFPWPLWICRNTLLGTALVRGFNAFSSIASYVGVKRKPMSKEVREAYVAPFNSWANRISTLRFVQDIPLKPGDRNYELVSEIAASLPKFAKVPTLICWGLKDFVFDKHFLDQWKVEMPHAVVHEFADCGHYILEDAGDEVVGHITDFMTSDPVAV

SEQ ID NO: 278 - protein, 324 aa, Shewanella sediminis
MNIKPNTLRTPDDAFVGLNDYPFEANYRQVDGMRLHYIDEGKENAKAIFLLHGQPSWSYLYRHMIPLLVDAGYRVIAPDLIGFGKSDKPMDSETHTYANQVKWMGDFVRQLGVNNASAFMQDWGGMIGLRVLAQQPQWLDRLVLANTALAEMSKLEKFMVPKILKLLAVMAGKPSLEKFMGNINYGNWAGYFRHAESLQIGQIIQSLTTRVLNEDEMRAYDAPFPTPQYYAAPRKMPEIVASELDEVNADWEKLKRWNKPMLTLFSDKDPFLADQGYDKKFQKNFSGALGQPHMTVENASHFLQEDQSKLLATRLSCWLQQTSY

SEQ ID NO: 279 - protein, 301 aa, Shewanella pealeana
MLDTLHPFKRNYLDRNGNKLQYVNEGQGEPVVMVHGNPSWSFYYRNLISALSDKHQCIVPDHIGCGLSDKPDDSGYDYTLKNRIDDLEALLEHLDVKENITLVVHDWGGMIGMGYAARYPERIKRLVILNTGAFHLPVSKPFPWALSICRNTMLGTLLVRGFNAFSSAASYVGVKRKPMHKDIREAYVAPFNSWANRISTLRFVQDIPLKPGDRNYELVSDIAASLSKFQDVPTVICWGLQDFVFDKHFLTEWKQRMPHAEVHEFADCGHYILEDASDEVIGHIQAFIAKTDKQTPTESVA

SEQ ID NO: 280 - protein, 299 aa, Desulfococcus oleovorans
MATPVDKTPFAHLYPFDSHFVEINGWNCHYLDEGAGEPLLMLHGNPTWSFYYRELVKRFSPDFRVVCPDHIGCGLSDKPPADQYGYRLKDRVNDIETLVNHLNLDGITLIVHDWGGFIGCAFALRNLEKIKRVVITNTAAFLKISGKPIPARLRVLRHIAPFAVPAVLGANLFARAALYMAPKKKLPPDVKAGLIAPYNSWANRIATLKFVQDIALSEKDPSYEMGRFLDDNLYKLSGFPMLICWGLHDFVFDTDYFAEWQRRFPHAESHGFETAGHYLLEDEPEQVGDRIKAFLKKHP

SEQ ID NO: 281 - protein, 302 aa, Shewanella baltica
MLDTLLPFKRHFLSRNGNKLHYINEGQGEPVVMVHGNPSWSFYYRNLVSALKDTHQCIVPDHIGCGLSDKPDDSGYDYTLKNRIDDLEALLDSLNVKENITLVVHDWGGMIGMGYAARYPERIKRLVILNTGAFHLPETKPFPWPLWICRNTLLGTVLVRGFNAFSSIASYVGVKRQPMSKYIREAYVAPFNSWANRISTLRFVQDIPLREGDRNYQLVSDIAASLPQFAKVPTLICWGLKDFVFDKHFLAKWRQHMPHAIVHEFADCGHYILEDASDEVIAHIKSFMADDQAAAPSEQAAG

SEQ ID NO: 282 - protein, 293 aa, Chloroflexus aurantiacus
MVIHTEVPAPIRALFPFHVHEYALPAGVMRYVDEGSGTPVVLLHGNPTWSFFYRRLIPLLRTQRRVIAPDHLGCGLSDKPQHYRYSLVNHIANLESLLTWLDVGPVDLVVHDWGGAIGMGWAVRHPDLVRRIVVLNTAAFLSPHVPLRIAAGKLPRLGEWAIRQLNAFAIAATTMAVTRPLPAAVREGYLWPYRTFADRIAIARFVQDIPLHPGHPTWPVVDAIDRELVHLRDKPVRIFWGGRDWCFDDRFLAGWLHRFPSAHVTRLDDAGHYVLEDASAEMIALLAHWLLSE

SEQ ID NO: 283 - protein, 301 aa, Shewanella halifaxensis
MLDTLHPFKRNYLDRNGNKLQYVNEGQGEPVVMVHGNPSWSFYYRNLISALSDKHQCIVPDHIGCGLSDKPDDNGYDYTLKNRIDDLEALLEHLDVKQNITLVVHDWGGMIGMGYAARYPERIKRLVILNTGAFHLPASKPFPWALSICRNTMLGTFLVRGFNAFSSAASYVGVKRKPMHKDIREAYVAPFNSWANRISTLRFVQDIPLKPGDRNYELVSEIAASLSKFQDIPTVICWGLQDFVFDKHFLTEWKQRMPHAKVHEFSDCGHYILEDASDEVIGHIKEFMAKTEQQTATESVA

SEQ ID NO: 284 - protein, 297 aa, Shewanella woodyi
MLDTLFPFKRNYLYRDGHKLQYVNEGEGEPVVMVHGNPSWSFYYRNVVTALSGKHQCIVPDHIGCGLSDKPDDSGYDYTLKNRIDDLEALLDHLNVKENITLVVHDWGGMIGMGYAARYPERIKRLVVLNTGAFHLPESKPFPWPLWICRNTLLGTALVRGFNAFSSIASYVGVKRKPMPAEIRKAYVAPFNSWANRISTLRFVQDIPLKPGDRNYELVSEIAASLPKFANVPTLICWGIKDFVFDKHFLAQWKVEMPHATVHEFADCGHYILEDASEEVVGHISDFISNDSLIANS

SEQ ID NO: 285 - protein, 301 aa, Xylella fastidiosa
MSYHDYPFLSQCFEVRPGIRMRYLDEGPRDAAVVVMLHGNPSWSYYWRHLVAALRDGYRCIVPDHIGMGLSDKPGDAPGVVPRYDYTLQSRVDDLDALLRHVGIDDVTPLTLAVHDWGGMIGFGWALAHAVQVRRLVITNTAVFPMPMSKKMPWQIALGRDWRFGEWMVRGLNAFALGAAWLGVETRLPRAVRRAYLAPYNSWANRISIIRFMQDIPCAPGDRAWPLLEAAGKALPNFADRPVFIGWGMQDIVFDHHFLDEFRAALPCAQVQVFGDAGHYVLEDKSSVLVPAIRAFLDAHP

SEQ ID NO: 286 - protein, 296 aa, Opitutus terrae
MTSSLPGWLARLYPFTPRSFTTPRGARMSYVDEGPRSAEAVLMLHGNPTWSFYYRELITALVPTLRCIAPDHVGMGLSDKPAGYDYSLATRIDDVAALVAQLGLTRVHLVVHDWGGAIGFGFAARHPALIGKLVILNTAAFASRHIPRRIALCKVPVIGPLLVRGLNGFAGPATWMAMHRRALTPDEKRGYLWPYSSWANRVAVSAFVRDIPMSPACRSWATLTEIENALPHFRDRPALILWGGQDFCFNDHFLARWRELLPAAEVQRIADAGHYVLEDAREEVIPQITTFFRGRD

SEQ ID NO: 287 - protein, 357 aa, Xylella fastidiosa
MGGAAGGRKSGCGPSGVWPGVYRGQTARRAGVPSLAGIRASSGNRRRFHIRSVTSRMSYHDYPFLSQCFEVRPGIRMRYLDEGPRDAAVVVMLHGNPSWSYYWRHLVAALRDGYRCIVPDHIGMGLSDKPGDAPGVVPRYDYTLQSRVDDLDALLRHVGIDDVTPLTLAVHDWGGMIGFGWALAHAVQVRRLVITNTAVFPMPMSKKMPWQIALGRDWRFGEWMVRGLNAFALGAAWLGVETRLPRAVRRAYLAPYNSWANRISIIRFMQDIPCAPGDRAWPLLEAAGKALPNFADRPVFIGWGMQDIVFDHHFLDEFRAALPCAQVQVFGDTGHYVLEDKSSVLVPAIRAFLDAHP

SEQ ID NO: 288 - protein, 357 aa, Xylella fastidiosa
MGGAAGGRKSGCGPSGVWPGVYRGPTARRAGVPSLAGIRASSRNRRRFHIGSVTSRMNYHDYPFLLQCFEVRPGIRMRYLDEGPRDAAVVVMLHGNPSWSYYWRHLVAALRDGYRCIVPDHIGMGLSDKPGDAPGVVPRYDYTLQSRVDDLDALLRHVGIDDVTPLTLAVHDWGGMIGFGWALAHAVQVRRLVITNTAVFPMPMSKKMPWQIALGRDWRFGEWMVRGLNAFALGAAWLGVETRLPRAVRRAYLAPYNSWANRISIIRFMQDIPCAPGDRAWPLLEAAGKALPNFADRPAFIGWGMQDIVFDHHFLDEFCAALPGAQVQVFDDAGHYVLEDKSSVLVPAIRAFLDAHP

SEQ ID NO: 289 - protein, 309 aa, Mycobacterium tuberculosis
MAQLREEQIMDVLRTPDSRFEHLVGYPFAPHYVDVTAGDTQPLRMHYVDEGPGDGPPIVLLHGEPTWSYLYRTMIPPLSAAGHRVLAPDLIGFGRSDKPTRIEDYTYLRHVEWVTSWFENLDLHDVTLFVQDWGSLIGLRIAAEHGDRIARLVVANGFLPAAQGRTPLPFYVWRAFARYSPVLPAGRLVNFGTVHRVPAGVRAGYDAPFPDKTYQAGARAFPRLVPTSPDDPAVPANRAAWEALGRWDKPFLAIFGYRDPILGQADGPLIKHIPGAAGQPHARIKASHFIQEDSGTELAERMLSWQQAT

SEQ ID NO: 290 - protein, 307 aa, Burkholderia cenocepacia
MIRSDATFDGTFPFAPHFDDASGFRMHYVDEGPRDGEIVLCLHGEPTWGYLFRHLVTALSPTYRVVAPDHMGFGKSATPQDRSYWLQDHIDNLERFVLAHDLDRITLVMHDFGGPVGMGLAARHPDRIRRIVSANGPTPFGQTDLAERLTANGRDAPWFQWIMRAAADGTLETVLGQLGFNILSTLKLNGFEDHAIITDTWIAAYGAPFAQPADCLGAIGWARGFAAGAHRFEEPDAAALRAIRGKPALAIWGDADRTLGAEHFLPLFTALFPSAPIERLAGVGHYCFEDAPDAIAARIADFIRTTG

SEQ ID NO: 291 - protein, 292 aa, Blastopirellula marina
MLAPADWRKLYPFASHTLDLDGQRYHYVDEGAGKPILFVHGNPTWSFYWRNLIQAFRGSHRTLAVDHIGCGLSDKPQNYEYTLEQHIDNLTRFLERLDLRDVTLAVHDWGGAIGLGAAVRQPERFERLILFNTGAFPPPYVPWRIFACRAPVIGNAAMRGLNLFARAAITMATEKPERMTPEVTAGLLAPYDSWANRVAISRFVGDIPLSPRHPTYATLQHLEQHLPDLQQKPIQMIWGAQDWCFTLECLKRFQSYWPQAESHVFDDAGHYVVEDAHERIIPLVESFLQRTA

SEQ ID NO: 292 - protein, 286 aa, Flavobacteriales bacterium HTCC2170
MEKFKIDEQLYPFKSNYIKINNEIKVHYVDEGEGPVILMLHGNPTWSFLYRKMINELKDEYRVIAPDYPGFGLSPTPLKYDFLPSTHSQIIEEFINLLDLKEIILVMQDWGGPIGLNIAINNPELVRGMVLGNTWAWPLKRFGQKMFSHIMGGYIGRWMAHSFNGVWHVFMKKGFVKSPSNRELAMYKAPFENSENSKQTAIFPKELYNSKSFLAKIESSLNILKEKPVLFTWGKHDFAFQKPELSIFQSIFKNHEVKMLDASHFWQDEQGELASKYIKNWASKTN

SEQ ID NO: 293 - protein, 297 aa, Psychromonas sp. CNPT3
MNMHNNIDSLFPFQRNYLERNGQKYHYVNEGQGEPVVMIHGNPSWSFYYRNLVQALRHENQCIVPDHIGCGFSSKPGDDDYDYCLKSRIDDLEALLDSLNINENITLVVHDWGGMIGMGYAERHPDRIKRLVILNTSAFHLPSTKKLPLALYICRNTCLGTLLVRGLNAFSAVASYIGVKRKPMTKDVREAYVMPFNSWKNRISTLRFIQDIPLSESDKSYALVSRISASVSQFKDTPTLICWGSQDFVFDAHFLALWKEKMPHAQVNEFTDCGHYILEDASAEVIPLITEFIKQNK

SEQ ID NO: 294 - protein, 303 aa, Photobacterium profundum
MLDTLFPFKRNFLSRNGHKLHYVNEGQGEPVVMVHGNPSWSFYYRNLVTELSQNHQCIVPDHIGCGLSDKPDDTGYDYTLKNRIDDLEALLEHLEIRENITLVVHDWGGMIGMGYAARYPDRIKRLVILNTGAFHLPDTKPFPWALWICRNTLLGTGLVRGFNAFSSIASYIGVKRKPMSPEVRKAYVSPFNSWANRISTLRFVQDIPLRKGDRNYEFVSEIAASLPKFSHVPTLICFGLKDFVFDKHFLAVWREKMPHATVHEFEDCGHYILEDACDEVVPLISDFMKTPLETDNKPSEADL

SEQ ID NO: 295 - protein, 293 aa, Desulfuromonas acetoxidans
MVKRLLPFQGNTLTLANNLRYHYLDKGQGDPVVMVHGNPSWCYYYRHLAVALSASHRVIVPDHIGCGLSDKPDDSRYRYTLEQRIADLETLLDHLQIKENITLVVHDWGGMIGMAYATRYPERIKRCVVLNTGAFHLPPSKPLPKALKLCRDSKLGAFLVRGFNAFSRGAAWVGCKINPMPPALRAAYMAPYNTWNNRIATLRFVQDIPLDPSDRAYAEVSRVADNLHLLVDKPMFIGWGEKDFVFDHHFLAEWQKRFPNAQYHTWPRGGHYILEDVGDELIPLICRFIQETK

SEQ ID NO: 296 - protein, 298 aa, Geobacter sp. FRC-32
MAMDITKHYPFTSNYLDLNGLAYHYLDEGSGDPVVMVHGNPSWSFYYRNLVLALRDRYRCIVPDHMGCGFSDKPGDDRYEYTLPRRVDDLERLIDHLKVNKNITLVVHDWGGMIGMAYAVRHPERIKRLVILNTAAFHLPKEKPFPLALKICRDTMLGTLLVRGFNAFSLAASFVGCKRNPMNAELRKAYQAPYDSWQNRIATLRFVQDIPLAPGDRNYDMVSSVESGLEQFRNLPMSIFWGELDFVFDRAFLAQWKRRFPAAEVHSYGDAGHYILEDMGNEIIPLISDFLSRTEIKP

SEQ ID NO: 297 - protein, 294 aa, Chloroflexus aggregans
MPMTASFVHSPIRTLFPFQISAYTTPSGVIRYVDEGVGPPVVMLHGNPTWSFFYRRLITALHNRRRVIAPDHLGCGLSDKPQNYHYCLANHIANLEQLLVHLATGPVDLVVHDWGGAIGMGWAVRHPELVRRIVVLNTAAFLSPHIPLRIAAAKMPRFGEWTVRRFNAFALAATVWAVERPLPPEVRAGYLWPYDTPAHRIAIARFVQDIPLHPAHPTWPLIDAIDRELVCLRDKPMRIVWGGRDWCFDDRFLAGWLKRFPDAEVTRLDDAGHYVLEDASDDVIARIARWLLVE

SEQ ID NO: 298 - protein, 298 aa, Geobacter lovleyi
MALDLAKEYPFKSNYLDLNGLKYHYLDEGQGPTVVMLHGNPSWSFYYRNLVKEISNRFRCIVPDHIGCGLSDKPGDDRYDYTLPQRVDDLEQLLDSLQLNEKITLVVHDWGGMIGMAWAVRHPERIERLVILNTGAFPLPKAKPFPLGLRICRDTWLGTLLVRGFNAFSRGAARVGCKENPMSAELRALYELPYDSWQNRIATLRFVQDIPLLPGDRNYDLICAVSDGINRFAGLPMLICWGELDFVFDHHFLAEWQTRFPKAELHRFPKAGHYILEDRKDTVIPLICEFMDRTVLST

SEQ ID NO: 299 - protein, 304 aa, Unknown
  marine gamma proteobacterium HTCC2080
MISANETFDGTWPFPPCFSTAAGFKQHYIDEGPRDGEVVVLLHGEPTWGYLYRNMIPGLTAKYRVIVPDHMGFGKSETPQDKEYTLRTHVENLEALIEELRLTDITFVGQDWGGPITGAFTARNPKKVQRLFLMNTVLGFGGGKASGGKTPWFQWIEKHANAGTLEGILGEMGSTVLSVMKIIGFQNSRDVSDTWIDAYSAPFPDRASCIGAISFPLDVHEGRFLPFVRETLEHGDLDALRAKPAMLISGDKDFGIAKDHAISDFKGLFPSSPIVDVEGVGHFCQEDIPDTLVALIDSFIQSNP

SEQ ID NO: 300 - protein, 296 aa, Stenotrophomonas maltophilia
MSQLPGYPAHPQRFEVRPGLSMNYLDEGPRDGEVVVMVHGNPSWSYYWRTLVAGLSDTYRCIVPDHIGMGLSDKPDDSRYEYTLQSRVDDLDALLKHLGITGPVTLAVHDWGGMIGFGWALSHHDQVKRLVVLNTAAFPMPAAKKMPWQIALGRHWKIGEWIIRTFNAFSSGASWLGVERKMPADVRRAYVSPYNSYANRISTIRFMQDIPLSPADKAWSLLERAGKALPSFADRPAFLGWGLRDFVFDHHFLKGFQAALPQAQVHAFEDAGHYVLEDRHEVLVPEIRAFLDKNPI

SEQ ID NO: 301 - protein, 296 aa, Stenotrophomona maltophilia
MSQLPGYPAHPQRFEVRPGLSMNYLDEGPRDGEVVVMVHGNPSWSYYWRTLVAGLSDTYRCIVPDHIGMGLSDKPDDSRYEYTLQSRVDDLDALLKHLGITGPVTLAVHDWGGMIGFGWALSHHDQVKRLVVLNTAAFPMPAAKKMPWQIALGRHWKIGEWIIRTFNAFSSGASWLGVERKMPADVRRAYVSPYNSWANRISTIRFMQDIPLSPADKAWSLLERAGKALPSFADRPAFLGWGLRDFVFDHHFLKGFQAALPQAQVHAFEDAGHYVLEDKHEVLVPEIRAFLDKNPI

SEQ ID NO: 302 - protein, 296 aa, Stenotrophomona maltophilia; identical to SEQ ID NO: 10

SEQ ID NO: 303 - protein, 300 aa, Xanthomonas campestris; identical to SEQ ID NO: 240

SEQ ID NO: 304 - protein, 304 aa, Ralstonia pickettii
MRTDTFDGMYPYAPRFTDAPGFPMHYVDEGPADGEVVLCLHGEPTWGFLFRHLIAVLRGTHRMVVPDHMGFGKSGTPPSRSYWLQDHIDNLERFVLALDLRDITLVMHDFGGPVGMGLASRHPDRVRRIVSVNGPTPFGQATLGERLAANAAVSPWFQWIVRAESEGRIEAVLGELGFNILSTLKLNGFEDHRLINDAWLQAYGARFATPADCVGAIGWAKGFATGAHRFELPDAAARRAIVTKPAMAIWGMADRTLHAEHFLPLFSELFPDAPVHRLPGVGHYSLEDAPDAIADRIATFLGQT

SEQ ID NO: 305 - protein, 298 aa, Microscilla marina
MQVLQTPDHQFEHLPEYPFAPHYAPVASNLQMHYVDEGSPNAEVVLLLHGEPSWSFLYRKMIPVITKAGYRAIAPDLIGFGKSDKPANIQDYSYKRHLDWMQAFIDHLGLNNITLFCQDWGGLLGLRMVAENSDKFKRVVASNTFLPTGDIKMPESFVQWKQFSQTVPEFPVGNIIQKATTTELSSDIVAAYNAPFPDESYKAGARVFPALVPDSPTSPESEANRNAWKVLSQWTKPFLTCFGDADPITKGADKFFQQMIPGTKGQAHTTVAGGGHFIQEDRGEELGKIVVEFIKANK

SEQ ID NO: 306 - protein, 303 aa, Shewanella putrefaciens
MLDTLLPFQRHFFNRNGNKLHYINEGHGEPVVMVHGNPSWSFYYRNLVSALKDSHQCIVPDHIGCGLSDKPDDSGYDYTLKRRIDDLEALLDSLNIKENIILVVHDWGGMIGMGYAARYPERIKRLVILNTGAFHLPESKPFPWPLWICRNTLLGTVLVRGFNAFSSIASYVGVKRQPMAKYIREAYVAPFNSWSNRISTLRFVQDIPLREGDRNYQLVSDIAASLPKFAKVPTLICWGLKDFVFDKHFLAKWRQHMPHATVHEFADCGHYILEDASDEVIAHIKGFMADEQVTSASSERAAG

SEQ ID NO: 307 - protein, 300 aa, Geobacter bemidjiensis Bem
MTLDIKAHYPFTGRTLDLGGLSYHYLDEGAGEPVVMVHGNPSWSFYYRNLVLALRDNFRCIVPDHIGCGFSDKPGDDRYDYTLARRIDDLERLIDHLHPEGKITLVLHDWGGMIGMGYANRHPERIGRIVLLNTAAFHLPKEKPFPLGLKICRDTALGTLLVRGFNAFSVGASIVGCKKNPMPCELQQAYRSPYDSWANRIATLRFVQDIPLAPGDRNYDLVSEIAAGLERFADLPIAIFWGELDFVFDRTFLAEWRRRFPKAKVKNYPDAGHYILEDMKQEVVPMIAEFLRETKPGEIR

SEQ ID NO: 308 - protein, 302 aa, Shewanella baltica
MLDTLLPFKRHFLSRNGNKLHYINEGQGEPVVMVHGNPSWSFYYRNLVSSLKDTHQCIVPDHIGCGLSDKPDDSGYDYTLKNRIDDLEALLDSLNVKENITLVVHDWGGMIGMGYAARYPERIKRLVILNTGAFHLPETKPFPWPLWICRNTLLGTVLVRGFNAFSSIASYVGVKRQPMSKYIREAYVAPFNSWANRISTLRFVQDIPLREGDRNYQLVSDIAASLPQFAKVPTLICWGLKDFVFDKHFLAKWRQHMPHATVHEFADCGHYILEDASDEVIAHIKDFMADGQAAAPSEQVAG

SEQ ID NO: 309 - protein, 292 aa, Planctomyces maris
MTFRDQIKNEYPFESHWLKIDGHQYHYLDEGAGPVLLMVHGNPTWSFAWRRLVKQLSQKYRVIAVDHMGCGLSDKPQQYSYQLATHIENLKTLIQELDLQKITLFAHDWGGAIGMGAAVDLPDRFQQFVLMNTAAFRSQEIPLRIAVCRIPFLGAWGVRGLNLFSGAAVKMAVEKPERMSAEVKAGFLGPYDNWQHRVAVHQFVKDIPLKSSHPSYQTLQHVEEGLQQFTGHPMLLIWGEKDWCFTTSFLDEFERRFPAAETLRIPDAGHYVFEDAHEVMLPRIEAFLEQHV

SEQ ID NO: 310 - protein, 290 aa, Lentisphaera araneosa
MKEKLQEIKDLYPFEPKDLKVEGQHRLSYVDEGEGQVMLMVHGNPTWSFFYRDLINEFSKTHRTVALDNIGCGTSDKPQDYDYTLENHISNLEKLVLALDLKDITLCVHDWGGAIGTGMATRHPDRIKNIIVFNTAAFRSQNIPKRIALCRVPFFGKVAVRAFNAFAGSATFMTTVKPLTDEVKHGFLLPYNNWENRIATHEFVLDIPLSENHRSYKTLLAVEEGLSQLKDVPMTIIWGKYDWCFDMTFLAKWKEFFPKAKVHEMEAGHYLFEDKGEEIIEIIKEFINKN

SEQ ID NO: 311 - protein, 301 aa, Marinobacter algicola
MNALRTPDKRFERLLDYPFAPHYVEVDGLRMHYVDEGPSDASPVLMMHGEPSWSYLYRHMIPICAAAGHRVIAPDLIGFGKSDKPTDINAYSYQSHMDWMQAFLEQTDLQNITLVCQDWGSLLGLRLAAENPDRFRAIVVGNGMLPTGDQPVPKAFQLWKNFALYSPWFPIARIINAGSFRTLGPDERRAYDAPFPDKKYKAGARAFPKLVPVTPDNPASAANREAWKVLEQWKKPFLTTFSNGDPITRGGDRYMQERIPGAKNQPHTTLTGGHFLQEDSPVEFAGAINALLARLDESDQT

SEQ ID NO: 312 - protein, 299 aa, Marinobacter algicola
MRILRTDEARFAGLPDYPFTPHYLDVEPGLRMHYVDEGPSDASPVLMLHGEPSWSYLYRHMIPLVADAGHRVLAPDLIGFGKSDKPADVGDYSYERHMAWLSAWLKAQGLKNITLVCQNWGSLLGLRLAAEHPQLFRRIIVGNGMLPTGETPVPAVFSLWKTFAAHSPWFPVGRIVQLGTERALSKAEIAAYEAPFPSAEFKAGARAFPKLVPVSGEDPSSDANKAAWRILETWKKPFITCFSSGDPITRGGDRYMQRRIPGAHGQPHITLRGGHFLQEDSPDDFARIIIDACKSEMAA

SEQ ID NO: 313 - protein, 292 aa, Moritella sp. PE36
MLDKLFPFKRNYLDRNGQQYHYLNEGTGEPVVMVHGNPSWSFYYRNLVSALSTNYQCIVPDHIGCGLSDKPDDNDYDYTLTSRIDDLEALLEHLDIKENITLVVHDWGGMIGMGYAARHPERIKRLVILNTAAFHLPLSKAFPLPLWICRNTVVGTFLVRGFNAFSSIASIVGVRRKAMSRDVRRAYVSPFNSWRNRISTLRFVQDIPLKPEDRNYQLVTDIGDSLAKFSTVPTLICWGLKDFVFDKHFLAQWKQRMPHAQVNEFDDCGHYILEDASDEVIELITDFMTDKR

SEQ ID NO: 314 - protein, 322 aa, Plesiocystis pacifica
MQVSVSKQLYPFAEHYFEVEPGLRMHYVDEGPREGAPVVVMVHGNPTWSFYWRRLIKALSPQFRVVAPDHMGCGKSDKPDDARYPYRLGRRIEDLGKLIAHLRLTEAGPIHLMVHDWGGMIGMGWAHAHEAEVDRIVLLNTAAFGLPPAKAMPGTLRLTRTGLGTVLVRGFNAFSRGANRYCVTRRPLDPAVAHGLIAPYDSWANRRAVLRFVQDIPLAPRDPGFDIVSEVGEALPKFDSHPVLICWGMRDFVFDKHFLEVWERKLPSADVHRFEDCGHYVLEDAGEEIEALVREFMAPAVVPTAAQDSAHKAAPSAAEASP

SEQ ID NO: 315 - protein, 357 aa, Opitutaceae bacterium
MVMENELHTTTASPFGPSCLPGWLRELYPFTPRTFITPGGARMSYVDECASREHPTPNKSGAGVPPASVPPTLDLGCSTFDVGRSSVRSTEAVLLLHGNPTWSFYYRELIPALVARGHRCIAPDHIGMGLSEKPSANHYSYTLPIRINDIAALVRSLGLTRIHLVVHDWGGAIGLGLATLHPELAGRIVILNTAAFHLPRIPRRIALCKTGFPGTLLVRGLNAFAGPATWMSMHRRHLTPDEKRGFLFPYDSWANRVAVDAFVKDIPLTPVHPTWRTLETTAAGLERFAVVDPDRKPEHPALILWGGRDFCFNDTFYDEWRRRWPHAQAHRIADAGHYVLADAAEEVIPRIADFLTP

SEQ ID NO: 316 - protein, 898 aa, Desulfatibacillum alkenivorans
MKRILLANSIGPYETGWGEDVNDLFSARLTRAQGPFTAKSIFPAFALHLLAENLNADVTIMEWPTEELFHKELKKDYDYLGIQVKSVHLSQIAGMVKIARAVAPDTKIILGGYGVMHIFHPYPNDPLNDAQYLKDNADHFCFEEGVTFFRKIIGQNPDDPISQVRQPMFEVTVQGGDHLARFPLSSTLVSLGCPNACEFCNTSHFFKFKKINVCSPEEAFASLKAASQRMAGQPSLFNMIWDEDFLLDRNYVLRLGELLQKDGLIGKVNLFCFASIKSISQYTVEELVRCGVGVLWIGVESKFEADILANHNFQKRVGRDVREVFEELHNHGILIIGSNILGLDFHNHKNILEDIDYFVSLKPDLYQVSPLRPCPGTTLYDRLMEDGRIEEEFRHQDTMLWSDIGLKHPNFKRGEIQKYFHLEHKRLLETNGPTILSVMDVMFKGYKTMVHSPDPFLQAKAERCYFFGKKLAAGFLPVIPEMIPTPAVRERASQIHEQYRRYVGDFGVKEKVAQRVIGRLMRKRAAMKPPESYTPDYLVTRVKGPDAEPKVVKRQRPVLHVLSQASIKGLRKVLGLREHNAFPIKLKDIDDFPVEFKTMEIEGNRMNYVDEGKGETLLMLHGNPTWSYLYRHFIKDLKKDYRCIALDHLGYGLSDKPHYEDYSMEAHIRRLGAFIEKLGLKDITLICQDWGGIIGLSYAARNKDLFSRLIPMNTTGFLPGSPKEFIQCLGAWAFPYLWSYKVPIAGKKMAMDWNVFLKAGMHLGIVNSKRQLHKRAMDGYLYPFQMVRDRTAIMKSVRQVPMGPLDKTWRLLHDTGRRLAGWNVRTQVIWGMKDPVFVPWFMEKFEEMLPNHAPSVKIATAGHFLQDDEPEIIIREIRRFLKEKQLKRKKGGGKKRAA

SEQ ID NO: 317 - protein, 280 aa, Shewanella benthica
MLDTLFPFKRNYLDRNGHKLQYVNEGLGEPVVMVHGNPSWSFYYRNLVSALSSNHQCIVPDHIGCGLSDKPDDSGYDYTLKNRIDDLEALLEHLDVKENITLVVHDWGGMIGMGYAARYPERIKRLVILNTGAFHLPQSKPFPWPLWICRNTMLGTVLVRGFNAFSSIASYIGVKRKPMPSEIRKAYVAPFNSWANRISTLRFIQDIPLKESDRNYELVSEIAASLPKFAHVPTMICWGLKDFVFDKHFLAQWKVEMPHASVHEFADCGHYILEDATEKS

SEQ ID NO: 318 - protein, 300 aa, Xanthomonas oryzae
MNYPGYPFTPKRLDVRPGVAMSYLDEGPRDGEVVVMLHGNPSWSYLWRHLVSGLSDRYRCVVPDHIGMGLSDKPDDAPDAQPRYDYTLQSRVDDLDTLLRHLGITGPVTLAVHDWGGMIGFGWALSHHAQVKRLVITNTAAFPLPAEKPMPWQIAMGRHWRLGEWFIRTFNAFSSGASWFGVSRRMPAAVRRAYVAPYNTWRNRISTIRFMQDIPLSPADKGWSLLERSAQALPTFADRPAFIAWGLRDICFDKHFLAGFRKALPHAEVTAFDDANHYVLEDKHEVLVPAIRAFLERHPL

SEQ ID NO: 319 - protein, 300 aa, Mycobacterium tuberculosis
MDVLRTPDSRFEHLVGYPFAPHYVDVTAGDTQPLRMHYVDEGPGDGPPIVLLHGEPTWSYLYRTMIPPLSAAGHRVLAPDLIGFGRSDKPTRIEDYTYLRHVEWVTSWFENLDLHDVTLFVQDWGSLIGLRIAAEHGDRIARLVVANGFLPAAQGRTPLPFYVWRAFARYSPVLPAGRLVNFGTVHRVPAGVRAGYDAPFPDKTYQAGARAFPRLVPTSPDDPAVPANRAAWEALGRWDKPFLAIFGYRDPILGQAGGPLIKHIPGAAGQPHARIKASHFIQEDSGTELAERMLSWQQAT

SEQ ID NO: 320 - protein, 321 aa, Gemmata obscuriglobus
MSNTSDPASLQLRTNALPDDDGPPFPNPAMPLFPFVSRVATRRGLRMAYLDEGRGDTVVMLHGNPTWGFYYRNLVLSLRESYRCVVPDHIGCGLSDKPGTDRYDYSLKSRIDDLEWLLEERGLTRDLTLVVHDWGGMIGMGFAARHPERVKRIVAMNTGGFPLPAGKKLPPSLWLGRNTKLGAWLITRRNWFCKFAAKWCATKRPLPADVKAGYLAPYDTPAHRVAVLKFVQTIPLAPSDPGYDIVSGAAASLEKFRDTPTLLLWGMKDFVFDRHFLEEWQRHFPHAEVHTWPDCGHYLLDDAGELAITRVWEFLQRHPLT

SEQ ID NO: 321 - protein, 296 aa, Paenibacillus sp. JDR-2
MNRPFELDPMEYPFTDRWLPYRDGYIHYLDEGQGPTVLLLHGNPTWSYLYRNVIKELREDFRLVAPDYPGFGMSKAPTGYRFTPQEQSAAIQDLINHLDLKDMIVVVQDWGGPIGLNYAVRHRNNLRGIVVMNTWAWPAEIMPMKLFSLAMGGWPIGRWLQTRRNFFAKIIVPHGIHHAEKVTDSLRKAYTDPFPTPKSRIPTWVFPRQIRKARKWLTDIESKLSNLSDLPAQILWGTKDSAGFPIEQMAKWQRYLPLNETEILEDASHYVQEDRPDRVVAAIRRIRKRVRGGVLL

SEQ ID NO: 322 - protein, 306 aa, Burkholderia ambifaria
MTPSNDTFDGTFPFSPRVSDVAGFRMHYVDEGPSDGEVVLCLHGEPTWGYLFRDLINALAGDYRVIAPDHMGFGKSETPKNRTYWLQDHIDNLEKLVLALDLNDITLVMHDFGGPVGMGLAARHPGRIRRIVSTNGPTPFGQSTLFDRLNANIAVSPWFQWILRADSQGRLESVLGELGFNILSTLKLNGFENHARISDTWLRAYGSRFAAPTDCAGAIGWAKGFAIGAHRFEVPDATTLDAVRSKTALAIWGEADRTLAAQHFLPLFSEIFPRAPIHQLAGVGHYGFEDAPQEIAGLIAGFLKAH

SEQ ID NO: 323 - protein, 182 aa, Arthrobacter chlorophenolicus
MVAAAWPGVDPQWSRELAVPSTSGADEPGTVRHWHVLDNGAQLEARGLTPEGTLLCVHGNPTWSYLWRTLLAAGSDPAHPWRVVAVDQLDMGFSERTGTFRRLADRVNDLGDLTTALGLDGPVVTVGHDWGGVISLGWALAHQDQLAGVVLTNTAVHQPSTSKNSAGAPAGPAPRRAPVGER

SEQ ID NO: 324 - protein, 426 aa, Arthrobacter chlorophenolicus
MTHSLAHPPLAADVHAAYMAPYRGASRRSGVGNFVADIPVDEFHPSFAALAGVAEGLRGLTVPALMLWGPRDPIFSDRYLKDLIGRLPHAKVHRFEGAGHLVAEDRDIATPVFEWLAAREGAGSASGLGGEGSDAAADTSAAPTGDPGIEAGSATPETAASPAAPEAAGFRPLWTLLDEQAAGPAGTGSAVVEMAPSGAAARSLSWQQLEQRIADLAAGLEQAGVQRGSRVSLMVPPGVDLTVALYACLRLGAVVVVADAGLGTKGLSRAVKGATPDFIIGIDKALAAAAALGWPGRRISAGTLPGARRRLLGAETSLSELARSGAGRKAAEHADALDPDALDPDALDPDAPAAVLFTSGSTGPAKGVLYTHRQLAAMRDTVANTFGIRGRVPTLVAGFAPFALLGPGAGCSVRHTGPWTSRRPAH

SEQ ID NO: 325 - protein, 300 aa, Xanthomonas oryzae; identical to SEQ ID NO: 251

SEQ ID NO: 326 - protein, 301 aa, Xylella fastidiosa; identical to SEQ ID NO: 243

SEQ ID NO: 327 - protein, 563 aa, Xylella fastidiosa
MIGWNGRCHSGGGIQHMKEPCNIAAVLPRLARERPEQIAIRCPGRPGSGGMAAYDLTLSYRELDRRSDAIAAGFSAYGIGRGVRTVVMVRPSPEFFLLMFALFKVGAVPVLVDPGIDRLALKQCLSEAEPQAFIGVFLAQLARRLLRWAPSVTRVVSVGRWAWCGTTLAHLERAGTGASAQLADTTADEVAAILFTSGSTGVPKGVVYRHRHFVGQIALLRETLSIVPGGVDLPTFPPFALFNPALGLTSIIPDMDPRCPARADPRKLHDAIARFGVSHLFGSPALLRVLAEYGKPLPTLRCVTSAGAPVPPQVVAQIRALLPDEAQFLTPYGATECLPVAVIESRELETTRAATERGAGTCVGHVIAPNLVRIIAIDDEGIEEWGGVREVGLGEIGEMTVVGPSATDVCYNRTAATRLAKIRERLADGSERIVHRMGDLGYFDAQRRLWFCGRKTHRVETVQGPLYTEQVEPVFNVIDGVRRTALVGIGALGAQRPVLCYEALPGVDVAALEQRLRATARAFIHTVGIVDVLRHPGFPVDIRHNAKIGRERLAVWATQRLRR

SEQ ID NO: 328 - protein, 584 aa, Photobacterium profundum
MDKGHEIDASKANICRHLTRAAKETPASLAVAVQKRSLFGKLRYEELTFGQLNTDSNAIAQALNDHGIKRGMKAVLMVTPSLDFFALTFALFKAGIVPILVDPGMGVKNLKQCFDEAKPDAFIGIPKAHIARCLFGWGKPSVRRLLTVGGNDVFANIFGGTTLKALLKRNTVIKPRSKMHQAIDYDIAKLKNDEMAAILFTSGSTGTPKGVVYTHAMFEAQISVLKNDYGIAHGERDLATFPLFSLFGPALGMASIVPDMDASKPITANPDSLFAAIEQYQCTNMFVNPALIERLGKAGTQHHKPHTLPSIKRVISAGAPATISSISRFSKMLKDGVEVLNSYGATESLPLTMIGSDQLMKTTDVTDNGGGICVGQAVDGVDIAIIAITDDPITTWDETLRLPVNQIGEIVVKGPMVSRAYYHRDHATVQAKITDGANTVRHRMGDLGYLDDSGQLWMCGRKAHRVEANRVAVASDKLPYFSIPCERIFNTHSSVKRTALVGIERHGETVPLLCVELNKGTSLTDDTARNTFFAELKTIGAKHQQTVGIVDFLIHSNFPVDIRHNAKIFREKLAVWAQKEGKAS

SEQ ID NO: 329 - protein, 559 aa, Xanthomonas axonopodis
MGDNAPMTTLCNIAATLPQLARERPDQIAIRCPGGRGANGFAAYDVTLSYAELDARSDAIAAGLARHGIGRGARAVVMVRPSPEFFLLMFALFKAGAVPVLVDPGIDKRALKQCLDEAQPQAFIGIALAQLARRLLRWARSATQIVTVGGRYGWGGVTLARVERDGAGAGSQLADTAPDDVAAILFTSGSTGVPKGVVYRHRHFVGQIELLRNAFGMQPGGVDLPTFPPFALFDPALGLTSVIPDMDPTRPGSADPRKLHDAINRFGVTQLFGSPALMRVLADYGQPLPNVRLATSAGAPVPPDVVAKIRALLPADAQFWTPYGATECLPVAAIEGRTLDATRAATEAGAGTCVGHVVPPNQVRIIAIDDAAIADWSGVRELATGEVGEITVAGPTATDTYFNRDAATRIAKIRECCSDGSERVVHRMGDVGYVDAEGRLWFCGRKTHRVEAASGPLYTEQVEPVFNVHRQVRRTALVGVGAPGQQQPVLCVELQPGVSASAFAQVESDLRALGAAHPHTAGVARFLRHSGFPVDIRHNAKIGRETLAVWAAQQLHKRG

SEQ ID NO: 330 - protein, 556 aa, Xanthomonas campestris
MGDNGRMTTLCNIAASLPRLARERPDQIAIRCPGGRGANGMAAYDVTLSYAELDARSDAIAAGLALHGIGRGVRAVVMVRPSPEFFLLMFALFKAGAVPVLVDPGIDKRALKQCLDEAQPQAFIGIPLAQLARRLLRWAPSATQIVTVGGRYCWGGVTLARVERDGAGAGSQLADTAADDVAAILFTSGSTGVPKGVVYRHRHFVGQIELLRNAFDMQPGGVDLPTFPPFALFDPALGLTSVIPDMDPTRPATADPRKLHDAMTRFGVTQLFGSPALMRVLADYGQPLPNVRLATSAGAPVPPDVVAKIRALLPADAQFWTPYGATECLPVAAIEGRTLDATRTATEAGAGTCVGQVVAPNEVRIIAIDDAAIPEWSGVRVLAAGEVGEITVAGPTTTDTYFNRDAATRNAKIRERCSDGSERVVHRMGDVGYFDAEGRLWFCGRKTHRVETATGPLYTEQVEPIFNVHPQVRRTALVGVGTPGQQQPVLCVELQPGVAASAFAEVETALRAVGAAHPHTAGIARFLRHSGFPVDIRHNAKIGREKLAIWAAQQRV

SEQ ID NO: 331 - protein, 564 aa, Xylella fastidiosa
MIGWNGRCYSGGGIQHMKEPCNIAAALPRLASERPEQIAIRCPGRPGSGGMAAYDLTLSYRELDSRSDAIAAGFIAYGIGRGVRTVVMVRPSPEFFLLMFALFKVGAVPVLVDPGIDRSALKQCLSEAEPQAFIGVFLAQLARRLLRWAPSVTRVVSVGTRWAWCGTTLAHLERAGIGASAQLADTTADEVAAILFTSGSTGVPKGVVYRHRHFVGQIALLRETLGIVPGGVDLPTFPPFALFNPALGLTSIIPDMDPRCPARADPRKLHDAIARFGVNHLFGSPALLRVLAEYGKPLPTLRCVTSAGAPVPPYVVAQIRALLSDEAQFLTPYGATECLPIAVIESRELETTRAATERGAGTCVGHVIAPNLVRIIAIDDEGIAEWGGAREVDLGEIGEVTVVGPSTTDAYYNRTAATRLAKIRERLADGSERIVHRMGDLGYFDAQRRLWFCGRKTHRVETVQGPLYTEQVEPVFNVIDGVRRTALVGIGTLGAQRPVLCYEALPGVDVAALEQRLRATARAFIHTVGIVDVLGHPGFPVDIRHNAKIGRERLAVWAAQRLRC

SEQ ID NO: 332 - protein, 638 aa, Xanthomonas oryzae
MARGGGRLAIQMRSAVHGRATSSERRIGCVPCGTDPLWRRVRRLLRHTAARRWSAHWLQRSRVSSQPPAGGRCHWRIGDNARMTTLCNIAATLPQLARERPDQIAIRCPGARSANGFAAYDVTLSYAELDARSDAIAAGLALHGIGRGARAVVMVRPSPEFFLLMFALFKAGAVPVLVDPGIDKRALKQCLDEAQPQAFIGIPLAQLARCLLRWARSARQIVTVGRRYGWGGVTLARVERDGAGADSQLADTAPDDVAAILFTSGSTGVPKGVVYRHRHFVGQIDLLRNAFGMQPGGVDLPTFPPFALFDPALGLTSVIPDMDPTRPGSADPRKLHDAIARFGVTQLFGSPALMRVLADYGQPLPNVRLATSAGAPVPPDVVAKIRALLPADAQFWTPYGATECLPVAAIEGRTLDTTRAATEAGAGTCVGRVVAPNEVRIIAIDDAAIPDWSGVRVLATGEVGEITVAGPTTTDTYFNRDAATRIAKIRERRSDGSERIVHRMGDVGYFDAEGRLWFCGRKTQRVETAQGPMYTEQVEQIFNALPGIGRSALVGVGEMGRQRPVLCYEPDAYAWMSSPMEQEDVRQQLRSTAAAHPLTAGIADFLCHPGFPVDIRHNAKIGRETLAVWAAQQLHKSG

SEQ ID NO: 333 - protein, 525 aa, Streptomyces ambofaciens
MTTTAADFAGRLAERPDAVALVESRKGISRTTRRGELVRHCRRIAQDLREAGVRPGHKAVVMTRDAHDLTAVSYALVMLGAVPVLIEPRAEVGRCLQDIAPDVFIGEPLAHLGRRVLGWGRPHVRTALVTGSAPLSPGRRLVTRTPADDASPPQVREPDGDEPALIAFTSGSTGRPKGAEYRHSTLAGQLDALATLMDPRSEDVLLAGFLPVALLGPLLGLATVAPAVNHLAPARTSPQEVVGPLREHRASIVLASPAVLALIARHCARHDLTLPSVRQILSFGAPLRVGLADALRKAVPDDAEILSVYGATECLPVSAIGDHDLRASRTAPPAGHAGTCLGRPLPGIRARILEADATGLGEIAVTGPTVSPTYHARPVADTFTKSDTDHGVLHRTGDLGRLDDEDRLWFLGRKAHLITGTGFTLTTEDVEAAADTAPGIRRTALVGVGTAVCQLPVLCVEPMPSTPRARALEAVRAVLKDHPDGYRVGAVLIHTAFPTDPRHNSKIDRMRLAGWAAKRLRGRVR

SEQ ID NO: 334 - protein, 550 aa, Unknown
  uncultured marine microorganism
MNVADILGQSLPESVDKAALISGIGKSRRQLTFAELADEVDDLVQEFRFQGLRPGDKVLVAVPVSIETYVAMLAILKAGLVVMFIDPAHGAAEVARCLSAYPPAAIVATRVMLLLRFLSPEIRRIPVRIVAGTVRGGQDASLLTQHRSSEDSALLTFSSGSTGEPKAVVRTHGFLRHQLEILNRVVDPDPADIDFVAMPMFVLFNLANATTSVIPACNMKRPGRADPRVLLAQLQHEFATTMVASPALLERLADHCLRTQQSMAAMRCISTGGGPVGPTLPERLSAVAPNAVIKTVYGSTEAEPIASVINADISVSDKRAMRIGAGLLVGRPVQGCDVIIIPSRSGTPLGPYSEAEFAALALADGEVGEIIVSGRHVLPGYADPISNRETKIEVGRKRWHRTGDAGYFDQQGRLWLVGRSAAAIRDSRGTVYPFQVEYAVSAVRGIRRAALISDQGQRVLVLETSGNEFTADCIKAARCVADKQIDRIVTLRRIPMDRRHDAKVDYPSLRSLLDGRWTRLRLNALTLLARFGRFLRELRLKIRSLHIVGH

SEQ ID NO: 335 - protein, 550 aa, Xanthomonas campestris
MTTLCNIAASLPRLARERPDQIAIRCPGGRGANGMAAYDVTLSYAELDARSDAIAAGLALHGIGRGVRAVVMVRPSPEFFLLMFALFKAGAVPVLVDPGIDKRALKQCLDEAQPQAFIGIPLAQLARRLLRWARSATQIVTVGGRYGWGGVTLARVERDGAGAGSQLADTAADDVAAILFTSGSTGVPKGVVYRHRHFVGQIELLRNAFDMQPGGVDLPTFPPFALFDPALGLTSVIPDMDPTRPATADPRKLHDAMTRFGVTQLFGSPALMRVLADYGQPLPNVRLATSAGAPVPPDVVAKIRALLPADAQFWTPYGATECLPVAAIEGRTLDATRTATEAGAGTCVGQVVAPNEVRIIAIDDAAIPEWSGVRVLAAGEVGEITVAGPTTTDTYFNRDAATRNAKIRERCSDGSERVVHRMGDVGYFDAEGRLWFCGRKTHRVETATGPLYTEQVEPIFNVHPQVRRAALVGVGTPGQQQPVLCVELQPGVAASAFAEVETALRAVGAAHPHTAGIARFLRHSGFPVDIRHNAKIGREKLAIWAAQQPR

SEQ ID NO: 336 - protein, 547 aa, Xylella fastidiosa
MKEPCNIAAVLPRLARERPEQIAIRCPGRPGSGGMAAYDLTLSYRELDRRSDAIAAGFSAYGIGRGVRTVVMVRPSPEFFLLMFALFKVGAVPVLVDPGIDRLALKQCLSEAEPQAFIGVFLAQLARRLLRWAPSVTRVVSVGRWAWCGTTLAHLERAGTGASAQLADTTADEVAAILFTSGSTGVPKGVVYRHRHFVGQIALLRETLSIVPGGVDLPTFPPFALFNPALGLTSIIPDMDPRCPARADPRKLHDAIARFGVSHLFGSPALLRVLAEYGKPLPTLRCVTSAGAPVPPQVVAQIRALLPDEAQFLTPYGATECLPVAVIESRELETTRAATERGAGTCVGHVIAPNLVRIIAIDDEGIEEWGGVREVGLGEIGEMTVVGPSATDVCYNRTAATRLAKIRERLADGSERIVHRMGDLGYFDAQRRLWFCGRKTHRVETVQGPLYTEQVEPVFNVIDGVRRTALVGIGALGAQRPVLCYEALPGVDVAALEQRLRATARAFIHTVGIVDVLRHPGFPVDIRHNAKIGRERLAVWATQRLRR

SEQ ID NO: 337 - protein, 550 aa, Xanthomonas campestris
MTTLCNIAASLPRLARERPDQIAIRCPGGRGANGMAAYDVTLSYAELDARSDAIAAGLALHGIGRGVRAVVMVRPSPEFFLLMFALFKAGAVPVLVDPGIDKRALKQCLDEAQPQAFIGIPLAQLARRLLRWAPSATQIVTVGGRYCWGGVTLARVERDGAGAGSQLADTAADDVAAILFTSGSTGVPKGVVYRHRHFVGQIELLRNAFDMQPGGVDLPTFPPFALFDPALGLTSVIPDMDPTRPATADPRKLHDAMTRFGVTQLFGSPALMRVLADYGQPLPNVRLATSAGAPVPPDVVAKIRALLPADAQFWTPYGATECLPVAAIEGRTLDATRTATEAGAGTCVGQVVAPNEVRIIAIDDAAIPEWSGVRVLAAGEVGEITVAGPTTTDTYFNRDAATRNAKIRERCSDGSERVVHRMGDVGYFDAEGRLWFCGRKTHRVETATGPLYTEQVEPIFNVHPQVRRTALVGVGTPGQQQPVLCVELQPGVAASAFAEVETALRAVGAAHPHTAGIARFLRHSGFPVDIRHNAKIGREKLAIWAAQQRV

SEQ ID NO: 338 - protein, 553 aa, Xanthomonas axonopodis
MTTLCNIAATLPQLARERPDQIAIRCPGGRGANGFAAYDVTLSYAELDARSDAIAAGLARHGIGRGARAVVMVRPSPEFFLLMFALFKAGAVPVLVDPGIDKRALKQCLDEAQPQAFIGIALAQLARRLLRWARSATQIVTVGGRYGWGGVTLARVERDGAGAGSQLADTAPDDVAAILFTSGSTGVPKGVVYRHRHFVGQIELLRNAFGMQPGGVDLPTFPPFALFDPALGLTSVIPDMDPTRPGSADPRKLHDAINRFGVTQLFGSPALMRVLADYGQPLPNVRLATSAGAPVPPDVVAKIRALLPADAQFWTPYGATECLPVAAIEGRTLDATRAATEAGAGTCVGHVVPPNQVRIIAIDDAAIADWSGVRELATGEVGEITVAGPTATDTYFNRDAATRIAKIRECCSDGSERVVHRMGDVGYVDAEGRLWFCGRKTHRVEAASGPLYTEQVEPVFNVHRQVRRTALVGVGAPGQQQPVLCVELQPGVSASAFAQVESDLRALGAAHPHTAGVARFLRHSGFPVDIRHNAKIGRETLAVWAAQQLHKRG

SEQ ID NO: 339 - protein, 614 aa, Shewanella oneidensis
MTKVDDALFEHGASAVAVEQNNGRDNPTKPKDANICRHLKLAAHHIPHHLAVAVQQGKGKSFANLTYQELDFISLNKQSDAIAFALNAYGLTRGMKAVLMVTPSLDFFALTFALFKAGIIPVLVDPGMGIKNLKQCFIEAAPDAFIGIPKAHIARRLLGWGKASVKRLINVDANQSGVTDTLSRLLTGAPSLASMLSFTTKSSSAKLPEQVEYPMALLEHDEMAAILFTSGSTGTPKGVVYSHGMFEAQIQALKQDYGIAHGERDLATFPLFSLFGPALGMTSIVPEMDASKPITANPEFLFAAIEKYQCSNIFVNPALLERLGRAGEQTDSKNQHKLSSVKRVISAGAPATIASIARFSKMLSDGVPVLNSYGATESLPISMIASDELFTTTQVTDNGGGICVGRAIDGVKIEIIAITEADIPEWDNRLCLNAGEIGEIVVTGQMVSQSYYHREKATAASKIWDSERQTFRHRMGDLGYLDDSGRLWMCGRKAHRVDATQGGQFAKRYYSIPCERIFNTHPNVKRSALVGVTVKGQHGVGEIKPLICIELDQSLVCNKSAQLYQELMVIAEQYSQTQGIRRFLIHPDFPVDVRHNAKIFREKLAVWAQSQTKG

SEQ ID NO: 340 - protein, 548 aa, Xylella fastidiosa
MKEPCNIAAALPRLASERPEQIAIRCPGRPGSGGMAAYDLTLSYRELDSRSDAIAAGFIAYGIGRGVRTVVMVRPSPEFFLLMFALFKVGAVPVLVDPGIDRSALKQCLSEAEPQAFIGVFLAQLARRLLRWAPSVTRVVSVGTRWAWCGTTLAHLERAGIGASAQLADTTADEVAAILFTSGSTGVPKGVVYRHRHFVGQIALLRETLGIVPGGVDLPTFPPFALFNPALGLTSIIPDMDPRCPARADPRKLHDAIARFGVNHLFGSPALLRVLAEYGKPLPTLRCVTSAGAPVPPYVVAQIRALLSDEAQFLTPYGATECLPIAVIESRELETTRAATERGAGTCVGHVIAPNLVRIIAIDDEGIAEWGGAREVDLGEIGEVTVVGPSTTDAYYNRTAATRLAKIRERLADGSERIVHRMGDLGYFDAQRRLWFCGRKTHRVETVQGPLYTEQVEPVFNVIDGVRRTALVGIGTLGAQRPVLCYEALPGVDVAALEQRLRATARAFIHTVGIVDVLGHPGFPVDIRHNAKIGRERLAVWAAQRLRC

SEQ ID NO: 341 - protein, 583 aa, Rhodopirellula baltica
MKMSDGPCGRESSQVLAETAGSSGNVASRLTAIAKILPGAIAIAEPSGPAKRDGSDRDYALTTFKTLDERSTQTARGLLASGIEPGMRMVSLVPFGAQFIELVFAMMKAGVVVVLIDPGMDRKHLVGCLQEVNPDGFLGIPKAQAIRTILRSKFPNAKRNITVGRRWFWGGKTLRQILELGDQNSSLSLPDVQTLDDAAVIFTTGSTGPPKGVAYTHQTFHAQIDRIRSRYEIRQGSRDLACFPLFGLFDAVMGVTTVIPDMDPTRPADVDPQKLIQAARQWEVDQAFGSPALWKTVTRWCEANAIGRPFPTLKRVLSAGAPVPAATLQSLRRFVHEEAKIETPYGATEALPIASIESRAVISETGPAASKGKGVCVGSRFDGVQWKVIEINDGPIASIDQTKELPRGKIGELIVSGPMVTRRYVTRADQNALHKVHDESGENAEQFWHRMGDVGYLDDQDRFWFCGRKAHRVVSSKRTFFTIPCESVFNVDEQVDKCALVGVGKPGEQTPVLVVQPIDLTIGSDATRAKELEARLRDRAARNPLTQRIDRFVIRDQPLPVDIRHNSKIFREKLAAELNGDTQ

SEQ ID NO: 342 - protein, 528 aa, Photorhabdus luminescens
MTNICQPIVDAAQKYPEHLALQAPHSRDHSSGLSFQTFFSHASHFQHQLTQAGFVAGDRLLVIIQPGLVLYPLLIAILGLGLVPVMLERGLAKKQLREILRHSQLSAVITQPTLGKFWFLLPELWRLRRFVIGQRILGMKVLETPNQHLPLSSFICRDLPPDTTGLITFTSGSTGTPKGANRTHDSLLAQLYAITALFAEGKNEIDLHSFPVMVLHSLCCGNSSILPDFDFSHPATVDPQQIVKQVQGEGITCLSGAPAYMSKITDYAKNKGLSFPNVRTVIVGGAPANKALLENCLTVFPHARHLVVYGSTEVEPISTVEMTTQLNHWATHDGYLVGKPVTQAEICIREITANPQQITPLATGNVGEILVAGPHVLKDYIDNPQATKENKLPRKQGGIWHCTGDVGYLDTTGQLWLLGRVKDKVVLDDGRIIHPYVLEKRINELPGVTQSAFVLHPLGGAALILESATLPTDLPAILDELDLTLVTRIYCANPIPVDIRHNSKINRIALINMLRKGQLSSVPYKEKL

SEQ ID NO: 343 - protein, 805 aa, Bdellovibrio bacteriovorus
MKTIIALHGNPGHPEDWSLLQKSLDPNAYRLLAVEADSEEWIRLLTQDKSKKILLGHSWGGYRILKSLPKYQDYVEQVVLVTPYIKPERPLSAVAKGLLQLPILGDKLIQSSHTKSKDGFFADLIHPLKADALPYLAKVQERLQDWKLWQKTVANKMKMEAQPWSSGDVCKVPVTVIYGRQDKISQDYAQNEIVSKYPSHKIVHVDNAGHGLLWSHVQDILKVLTTEASSNASDSDSKIGYYPGEDGRNNVITYMEKHLSEFPERVALRWANPQALAQWNGDPKTPIKHDEITYRHFAARINSFARGLMDIGIKKGDRVIIFLPMSLDMYTAMFAVQRIGAIAVFLDSWARSHHLGASAECVGPKAMISFKMAFDLVEQVPEFKSMPIRVLYGPGDKFTHKFEELLKADPSPIEPVESEFTALITFTTGSTGKPKGANRTHRFLSAQHHALSHVIPYTEKDKDMPAFPIFSLNNLASGVTTILPALNLAAPAAHDSALLACQILHENINCTTLSPSMLVGVAKFCKENNIQLTGLRRVVTGGAPISKDDVKAFYEIAPQTDLWILYGSTEAEPMAHIEGRDMLKESNITDPEIIEEGVNVGHISEDIDYRFIRIKDGPIELKDSPWSQIEVANGEVGEFICTGDHVCRDYYNNPEAFKTTKIMDEKNRVWHRTGDLAYIDPDKNLWIVGRVNNAIERAGKYYFPVRAEVLLKRMDFTYRCAFLGMDDAKLGQATYAVVELKEGIDAATFDFATAKKEIQRVFEKNKIPVDEIKFVNKVPMDPRHHSKVEYKVLRDQLKEPGVVIG

SEQ ID NO: 344 - protein, 541 aa, Desulfotalea psychrophila
MLNIGRTLQEVAQKYGEQRGLVEAATGREMSFAELNRLSDSYAHYLRDSGVKSGDRVMLMVKPSADFICLTFALFKLGAPVILIDPGMGYKNLLRCIARVTPAVLIGIPKALLVSRLFRRTFSTIRLSFCCGSACGIFGPDIRRAGVKSMHAYPAHQPKKDDLAAIIFTTGSTGAPKGVRYEHDLFAAQREHVGKYYGIGVGDVDQPGFPLFALFSTSLGACAVIPDMDPTKPAQVDPQKYIASIEKYGVTYSFGSPAIWNVVSHYCVQKKIVLPSLKKVLMAGAPVSGELLQRVEKMLPKDAEIFTPYGATESLPIVSITGREILSSTWERSRRGAGACVGRALPGMEVRVITISDDPIACIEDVQVCAAGEIGEIIVRGNVVTRAYDNNAHETRLAKIEDGATFWHRMGDTGYLDVDGLLWFCGRRAHRVVTEAGTLFTIPCEAIVNEHDDVYRSALVAVKGIGGVTEPALIVEKKKGATISDGDLLEDVRALAAADPLTAEIEHFLVHRSFPVDIRHNAKIFREKLSVWASQELSRAK

SEQ ID NO: 345 - protein, 566 aa, Nocardia farcinica
MTVRWWAPVERFREFARADPDRAAVIHPDGIGGDGLPRYRTLTRRELDDWSEAIARRLLDAGVDTGTRTIVLVLPGPELYAILLGLFKIGAVPVVIDPGMGIGRMLRCLRAVDAAAFIGIPRAQVLRVLFRRNFAGVRTVVTVGRRWCWGGFRLAEFGRAPTGAGVLEGAAADPDEPLLIAFTTGSTGPAKAVRLTHGNLTAMLAAVDAERDHVPPDTSLVTLPLVGVLDLLLGARCVLPPLIPSRVGSTDPAHVVDAITRFGVRTMFASPAVLVPLLRHLRAHPAALPTLRSVYSGGAPVPAWCVAGLRDVLAEDVLVYAGYGATEALPISTVESRELLGGLVIRAHRGEGTCLGRPSPGVQVRIVAVTDEPIPTWAEAEALAPRLADTDGIGEIVVSGAHVSTGYHWPAEADRVGKIADDGRVWHRTGDLGRLDEQGRIWFCGRKSQRVRTATGTLCTVQVEQVFNAVPGVARTALVGVGAPGAQRPVLCVETEPGADRLAVELRLRTRGAEFALTESIDDFLFHPGFPVDIRHNAKIGREQLARWAAGRSTAGPARLREVIRR

SEQ ID NO: 346 - protein, 585 aa, Photobacterium profundum
MMDKGHEIDASKANICRHLTRAAKETPASLAVAVQKRSLFGKLRYEELTFGQLNTDSNAIAQALNDHGIKRGMKAVLMVTPSLDFFALTFALFKAGIVPILVDPGMGVKNLKQCFDEAKPDAFIGIPKAHIARCLFGWGKPSVRRLLTVGGNDVFANIFGGTTLKALLKRNTVIKPRSKMHQAIDYDIAKLKNDEMAAILFTSGSTGTPKGVVYTHAMFEAQISVLKNDYGIAHGERDLATFPLFSLFGPALGMASIVPDMDASKPITANPDSLFAAIEQYQCTNMFVNPALIERLGKAGTQHHKPHTLPSIKRVISAGAPATISSISRFSKMLKDGVEVLNSYGATESLPLTMIGSDQLMKTTDVTDNGGGICVGQAVDGVDIAIIAITDDPITTWDETLRLPVNQIGEIVVKGPMVSRAYYHRDHATVQAKITDGANTVRHRMGDLGYLDDSGQLWMCGRKAHRVEANRVAVASDKLPYFSIPCERIFNTHSSVKRTALVGIERHGETVPLLCVELNKGTSLTDDTARNTFFAELKTIGAKHQQTVGIVDFLIHSNFPVDIRHNAKIFREKLAVWAQKEGKAS

SEQ ID NO: 347 - protein, 598 aa, Colwellia psychrerythraea
MTETMDKSNQANLCRHLAHAAIATPNALAVAVQKNQRGKLTYQEIDFVSLHQRSDEIAYALNAYGLKSGMKAVLMVTPSIDFFALTFALFKAGIVPILVDPGMGIKNLKQCFVESAPDAFIGIPKAHIARVLFGWGKASVKKLLTVTDVNSGVGANVFASLIGGMSLTKLLTRYPIQNKDLPKENSSFDMVKLSDDAMSAILFTSGSTGTPKGVVYSHKMFEAQITALKEDYAIKPGERDLATFPLFSLFGPALGMASIVPDMDASKPIKANPAFIFAAIEKYQCTNLFANPALIEVLGQAGTTNVSAAKADTESVNKPIIKLNSLKRVISAGAPATLTSIERFTQLLSDNVPVLTSYGATESLPLTKIASVDLLATSHITDNGGGICVGTAVNGVEISIIEITEKPIEIWHDDLVLPANTIGEIVVKGDMVSHQYYNRASATEQAKILDADPNATCSKRDVVRHRMGDLGYLDDAGALWMCGRKAHRVETDKKVLFSIPCERIFNTHHSVKRTALVGVKINHKSVPLLCVELTDEAKNKKDFNEAILFSALKVAALAHKQTSAISHFLIHEKFPVDIRHNAKIFREKLAVWAQDEFN

SEQ ID NO: 348 - protein, 553 aa, Xanthomonas campestris
MTTLCNIAATLPQLARERPDQIAIRCPGARGANGFAAYDLTLSYAELDARSDAIAAGLARRGIGRGARAVVMVRPSPEFFLLMFALFKAGAVPVLVDPGIDKRALKQCLDEAQPQAFIGIALAQLARRLLRWARSAKQIVTVGGRYGWGGVTLARVERDGAGAGSQLADTAPDDVAAILFTSGSTGVPKGVVYRHRHFVGQIELLRNAFNMQPGGVDLPTFPPFALFDPALGLTSVIPDMDPTRPGSADPRKLHDAIARFGITQLFGSPALMRVLADDGQPLPNVRLVTSAGAPVPPDVVAKIRALLPADAQFWTPYGATECLPVAAIEGRTLDATRAATEAGAGTCVGQVVAPNEVRIIAIDDAAIADWSGVRVLATGEVGEITVAGPTATDTYFNRDAATRIAKIRERRSDGSERVVHRMGDVGYFDAEGRLWFCGRKTQRVETASGPLYTEQVEPVFNVHPQVRRTALVGVGAPGQQQPVLCVELQPGVSAPAFAQVESDLRALGAARPHTAGIARFLRHSGFPVDIRHNAKIGRETLAVWAAQQLHENG

SEQ ID NO: 349 - protein, 556 aa, Xanthomonas oryzae
MTTLCNIAATLPQLARERPDQIAIRCPGARSANGFAAYDVTLSYAELDARSDAIAAGLALHGIGRGARAVVMVRPSPEFFLLMFALFKAGAVPVLVDPGIDKRALKQCLDEAQPQAFIGIPLAQLARCLLRWARSARQIVTVGRRYGWGGVTLARVERDGAGADSQLADTAPDDVAAILFTSGSTGVPKGVVYRHRHFVGQIDLLRNAFGMQPGGVDLPTFPPFALFDPALGLTSVIPDMDPTRPGSADPRKLHDAIARFGVTQLFGSPALMRVLADYGQPLPNVRLATSAGAPVPPDVVAKIRALLPADAQFWTPYGATECLPVAAIEGRTLDTTRAATEAGAGTCVGRVVAPNEVRIIAIDDAAIPDWSGVRVLATGEVGEITVAGPTTTDTYFNRDAATRIAKIRERRSDGSERIVHRMGDVGYFDAEGRLWFCGRKTQRVETAQGPMYTEQVEQIFNALPGIGRSALVGVGEMGRQRPVLCYEPDAYAWMSSPMEQEDVRQQLRSTAAAHPLTAGIADFLCHPGFPVDIRHNAKIGRETLAVWAAQQLHKSG

SEQ ID NO: 350 - protein, 571 aa, Shewanella denitrificans
MTSPSANLCRHLNTAANETPTALAVAVQQAHSGLLSSKARFSYDEINFAQLDKRSDDIAFALNQQGIVAGMKAVLMVTPSIEFFALTFALFKAGIIPILVDPGMGTANLKQCFEDAQPQVFIGIPKAHIARQLLGWGKDSVRHCVNVGGGSLARLLSGAPSLDELLAQSIKRKVKQYPMVKLNDHEMAAILFTSGSTGLPKGVIYSHSMFEAQIEALRCDYGIKPGERDLATFPLFSLFGPALGMASIVPDMDASKPISAKPEYLFAAIEQYQCSNLFVNPALLERLGQAGVAMKHKLTSVKRVISAGAPASIDAIARFSTLLAEDVPVLNSYGATESLPISFIASQDLLPTAEATDKGAGICVGKAIQGVEIRIIAISDEPIATWQPELSLEAGQIGEIVVKGPMISQSYYRNDKANALAKINDPEGGMRHRMGDLGYLDELGNLWMCGRKAHRVDVLETQGTGAMIKRYLSIPCERVFNTHPQVRRSALVGIRLNGQVMPLLCIELDNSLACSDTKALYQSLKDIAAKHPHTQGIERFLIHPSFPMDVRHNAKIFREKLAIWAQAKWKE

SEQ ID NO: 351 - protein, 613 aa, Shewanella sp. MR-4
MVRVEDAQLGHGTSSVERASDANICRHLKQAAHHIPHHLAVAVQQGKGKSLANLTYQELDFISLDKQSDAIAFALSAHGLRRGMKAVLMVTPSLDFFALTFALFKAGIIPVLVDPGMGIKNLKQCFIEAAPDAFIGIPKAHIARRLLGWGKGSVQHLINVDGNPSGLAGTLSRLLTGAPSLATILSFSKKSSAAKSSTAKTSVAKLPEQAEYPMALLRHDEMAAILFTSGSTGTPKGVVYSHGMFEAQIQALKQDYGIAHGERDLATFPLFSLFGPALGMASIVPEMDASKPITANPEFLFAAIEKYQCSNIFVNPALLERLGRAGEQTESKKQHKLSSVKRVISAGAPATIASIARFSKMLSDGVPVLNSYGATESLPISMIASDELFTTTQTTDNGGGICVGRAIDGVSIEIIAITEADIPEWDNGLRLNAGGIGEIVVTGPMVSQSYYRRETATTAAKIWDREQQTFRHRMGDLGYLDDSGRLWMCGRKAHRVDATQGGQCIKRYYSIPCERIFNTHPNVKRSALVGIKVKGKDGASEIEPLICIELDQSLVCNKSAQLYQDLLAIAEQYSQTQGIRRFLIHPDFPVDVRHNAKIFREKLAVWAQSQTKG

SEQ ID NO: 352 - protein, 608 aa, Shewanella sp. MR-7
MARMEDAQLGHGTSSVEQASDANICRHLKQAAHHIPHHLAVAVQQGKGKSLANLTYQELDFISLDKQSDAIAFALNAHGLTRGMKAVLMVTPSLDFFALTFALFKAGIIPVLVDPGMGIKNLKQCFIEAAPDAFIGIPKAHIARRLLGWGKGSVQHLINVDGNPSGLAGTLSRLLTGAPSLATILLSAAKSSTAKTSVAKLPEQAEYPMALLRHDEMAAILFTSGSTGTPKGVVYSHGMFEAQIQALKQDYGIAHGERDLATFPLFSLFGPALGMASIVPEMDASKPITANPEFLFAAIEKYQCSNIFVNPALLERLGRAGEQTESKKQHKLSSVKRVISAGAPATIASIARFSKMLSDGVPVLNSYGATESLPISMIASDELFTTTQTTDNGGGICVGRAIDGVSIEIIAITEADIPEWDNGLRLNAGEIGEIVVTGPMVSQSYYRRETATTAAKIWDCEQQTFRHRMGDLGYLDDSGQLWMCGRKAHRVDATQGGQCTKRYYSIPCERIFNTHPNVKRSALVGVKVKGKDGASEIEPLICIELDQSLVCNKSAQLYQDLLAIAEQYSQTQGIRRFLIHPDFPVDVRHNAKIFREKLAVWAQSQTKG

SEQ ID NO: 353 - protein, 564 aa, Shewanella frigidimarina
MTQTSALANANICQHLKTAAQTMPAGLAVAVQHAKQGHFNYQEIDFVTLHQQSDMIAKGLIQYGIKRGMKAVLMVTPSIEFFSLTFALFKAGIIPILVDPGMGIKNLKQCFEESQPDAFIGIPKAHIARRVLGWGKGSVKQVINVGGSAIQRLLANATSLETITEIGRNIAHPLEMALLKPDDMAAILFTSGSTGTPKGVVYSHAMFEAQISALKHDYGITPGERDLATFPLFSLFGPALGMASIVPDMDASKPITANPAYLFAAIEQYQCSNMFVNPALLERLGQAGEQSQHKLNSVKRVISAGAPATISSIKRFSKMLNPQVEVLNSYGATESLPISMIGSHELFATSELTDQGKGICVGKPISSVSVDIIAITDTAQPHWAEVKKLATNEIGEIVVSGPMVSQAYYQRQHATELAKINDGEHVKHRMGDVGYLDDNGLLWMCGRKGHIVDATRGQQRIKRFYTLPCERVFNTHPQVKRSAIVGVKVGNNTVPVLCIELQKDIVCSTSKALYQELLVIAEQYPHTDGIGRFLIHPEFPVDVRHNAKIFREKLAVWAQKQWKE

SEQ ID NO: 354 - protein, 608 aa, Shewanella sp. ANA-3
MARVEDAQLGHGTSSVEQASDANICRHLKQAAHHIPHHLAVAVQQGKGKSLANLTYQELDFISLDKQSDAIAFALNAHGLTRGMKAVLMVTPSLDFFALTFALFKAGIIPVLVDPGMGIKNLKQCFIEAAPDAFIGIPKAHIARRLLGWGKGSVKHLINVDGNPSGLAGTLSRVLTGAPSLATILLSTAKSFTTKASAANLPEQGEYPMALLRHDEMAAILFTSGSTGTPKGVVYSHGMFEAQIQALKQDYGIAHGERDLATFPLFSLFGPALGMASIVPEMDASKPITANPEFLFAAIEKYQCSNIFVNPALLERLGRAGEQTESKKQHKLSSVKRVISAGAPATIASIARFSKMLGVGVPVLNSYGATESLPISMIASDELLTTTQTTDNGGGICVGRAIDGVSIEIIGITEADIPEWDNGLRLNAGEIGEIVVTGPMVSQSYYRREKATTAAKIWDRERQTFRHRMGDLGYLDDSGRLWMCGRKAHRVDATQGGQCIKRYYSIPSERIFNTHPNVKRSALVGIKVKGQGGVCEIEPLICIELDQSLVCNKSAQLYQELMAIAEQYSQTQGIRRFLIHPDFPVDVRHNAKIFREKLAVWAQSQTKG

SEQ ID NO: 355 - protein, 544 aa, Pelobacter propionicus
MSSHLVNIAAHLPRMADLQPDTPAIIFPRNDIQLSFRELDELSDRIAHGLTAIGISRGVRTVLMVPPGPEFFALTFALFKVAAVPVLVDPGLGVKNLKTCLDEAEPQAFIGITKAHLARLLFGWGKGSIHTLVTVGRRLLWRGATLSSLIADSDEEPFPPARTGRGETAAILFTSGSTGPPKGAVYNHGNFAAQVSALRQSYGIRPGEIDLPTFPLFALFAPALGMTAVIPEMDFTRPGSVNPAIIISTIQQYGATTMFGSPALIDRVSRYGAQQGITLPSLRRVISAGAPVPAAVMERFSDMLDPETEIFTPYGATEALPVCSIGSSEVLAETRHLTEQGRGVCVGLPVAGIDLAIIPISDTPIRHWGDDLALPDWEVGEITVKGPQVTASYLNRPEATSLAKIPDPSGGFWHRMGDLGYLDGEGRVWFCGRKAHRVITPMDTLYTIPVEGVFNSHPQVKRSALVGLGKPGRQQPVLCVETETGVSQEEHGRIRRELIALGSKYPHTKSILKILFHPSFPVDIRHNAKIFREKLAIWAAEQSR

SEQ ID NO: 356 - protein, 564 aa, Shewanella amazonensis
MNANLCRHLVSAAQAQPQGLAVAVQRHRFGKPPRGIGELCYDELTLSELNRRSDAIAHGLNAIGLNAGDKAVLMVTPGLDFFALTFALFKAGIIPVMVDPGMGIKNLGQCFDEAAPDAFIGIPKAHVARMLFSWGKKTVTQLVTVGRGLKLWGGNTLVQIEKHGQDMGPYPMTLLDEQALCAILFTSGSTGVPKGVEYSHQMFEAQIQALKQDYGIRHGERDLSTFPLFALFGPALGMASIVPCMDASRPIKAKPEYLFKAIADYQCTNLFLNPALLDKLGRYGEANALTLNGVRRVISAGAPASIDAINRFRQILPPDAPVLNSYGATEGLPLCFVGSDELLASGEVTAKGGGILVGKPVQGVALEIIAIDEAPIAEWQDELKLQPYEIGEIVVKGPMVSRAYYHRDEATSIAKIADDGEFWHRMGDLGYLDELGRLWMCGRKAHRVDATEGGAFSKRYFSIPCERIFNTHPLVARSALVGVHRHGDKIPLVCLELERSQACNNASSLYRELREMAEAHEITQGIDFFLIHESFPMDVRHNAKIFREKLALWAEKQLSGGLNK

SEQ ID NO: 357 - protein, 554 aa, Psychromonas ingrahamii
MSDHQYCNFCRHLIDAATAFPDSLAVAVQKKRFNKLTYQEIDFSTLNKRSDRIAHALNQFGLKSGDKAVLMVKPSVDFFALTFALFKAGIVPILIDPGMGIKNLKQCIAEVHPDAFIGIPKAHIARRLFGWGKDAIKYNITVGGASFWGGTSLTQIIDHCSAQTPYPMVKLTPDQMAAILFTSGSTGSPKGVVYTHRMFEAQITVLRNDYGITHGERDLATFPLFSLFGPALGMASIIPAMDASKPITANPDYIFAAINKYHCTNLFANPALIELLGRAGKSRAMKLQSLQRVISAGAPATLSSIERFTTLLNPGVEILTSYGATEALPVSKIGSVALLKTTDITDAGGGICVGYPVDGMTVSIINITEKTITTWQDDLRLPAYEIGEIVVQGPQVSQCYYQRKNATLAAKIEDIKRPHHRMGDLGYLDSDGQLWMCGRKAHRVDANHLKIKKSYYSIPCERIFNTHPAIKRSALVAVKIDGKTTPLLCIELYNKSAQTAETLFAELHKIADKHNQTVGITLFLIHKKFPMDIRHNAKIYREKLAIWAEKQLID

SEQ ID NO: 358 - protein, 581 aa, Mycobacterium vanbaalenii
MEPFPDDIFNLADIVLRVAREDPERIAVIDLDGWEGYGTRRYKPHTYAELSADVESVAVGLREMGIAELTRIVCMSPPSYETCVMGVALTRVGAFTIWIDPSVGYRNIAERLSRVHPEAFLGNALAHVGRITFGWGPRDLRKLVLTETPLSPGGRFITGFPPFPGARSIRSLRKHAPAEPEPPRVGPDDPCAVLYTTGSTGPAKPSLYLHRNFCQVFRNAHHSWGWDRDTEVPVDLAVFPAFLFIPISAGGTMVVPPIDFARQSPAKVNSAALIQVINDCKVGSFFAAPILIENLAREALARNLTMPSLKRVIGAGAPVTGPVEEMLTAVMAPDGELAANYGATEAMPSTEIGSREHLDGLWDMTEQGAGICVGYALPGVELKIIDIVDGPIDSIEETSELPEGKVGEILVRGKHVSPEYYLDPESTRKNKVPDPQGTWQRFGDVGYRDAQARLWVCGRVSQRVKAAGGTVFPLQVEPLFDVHPKVRRSALVGVPTPAGELPVLCVEVEPDVGKNELAGLHQELLARAAASEMANTIHTILFKRRLPVDPRHNSKIERQHLAKWAAKQLSGPASQAHRGWA

SEQ ID NO: 359 - protein, 608 aa, Shewanella sp. W3-18-1
MSTLLEKEVIPLVTETSLSTGTSQSAIASDANICRHLKQAAHDIPHHLAVAVQSAKGASVANLRYSELDFLSLDRQSDVIAFALNAHGITRGMKAVLMVTPSLDFFALTFALFKAGIIPILVDPGMGIKNLKQCFAEAAPDAFIGIPKAHIARRLFGWGKGTIKILLNVDGGKTGFAAKLNCMATGAMSLSTLLQNTSAQSSAQKSPYPMVLLKPNEMAAILFTSGSTGTPKGVVYSHAMFEAQIQALKNDYGICHGERDLATFPLFSLFGPALGMASIVPEMDASKPITANPEFLFAAIEQYQCSNIFVNPALLERLGRAGEQKQHTLPSVKRVISAGAPATIASIARFSKMLSDGVPVLNSYGATESLPISMIASDALFATTEMTDNGAGICVGHAIDGVSIGIIGISEAVIPEWDDALLLKNGEIGEIIVQGPMVSQSYYKYDSQRDNQRDSATAMAKIWDPVANCVRHRMGDLGYLDDQGRLWMCGRKAHRVDATHKGKFAKRYYSIPCERIFNTHPNVKRSALVGVKVANEITPLICIELDTSLVCNKSQQLYQELTTLAEQFHQTQGIKRFLIHPDFPVDVRHNAKIFREKLAVWAQSQTKG

SEQ ID NO: 360 - protein, 624 aa, Shewanella baltica
MSTLLETEVTPLLAAVVTPLDTSLLTGTSASAMASDANICRHLKQAAHAIPHHLAVAVQSAQGASVANLRYSELDFLNLDRQSDAIAFALNAHGIERGMKAVLMVTPSLDFFALTFALFKAGVIPILVDPGMGINNLKQCFAEAAPDAFIGIPKAHIARRLFGWGKCSIKSLLNVDGGKTGLAARLMRIATGAISLSTLLQNSSSRNSSAQHTQAQHAEYPMVMLKSDEMAAILFTSGSTGTPKGVVYSHGMFEAQIKALKNDYGICHGERDLATFPLFSLFGPALGMASIVPEMDASKPITANPEFLFAAIEKYQCSNIFVNPALLERLGRAGEQKQHKLPSVQRVISAGAPATIASIARFSKMLSQGVPILNSYGATESLPISMIASDALFATTDITDNGGGICVGGAIDGVTIRIIGISEAVIPEWNEALVLNNGEIGEIVVQGPMVSQSYYLNNSQHDRQNESQGHSATAAAKMWDSATNSVRHRMGDLGYLDDQGRLWMCGRKAHRVDATRKGQLVKRYYSIPCERIFNTHPNVKRSALVGVKVANEIEPLICIELDQSLVCNKSQQLYQDLITIAEQFAQTQGIRRFLIHPDFPVDVRHNAKIFREKLAVWAQSQTKG

SEQ ID NO: 361 - protein, 563 aa, Shewanella loihica
MSETIQVGANLCRHLNRAAKEAPNELAVAVQKACGVLNKQLEYQELNFAKLDAMSDILAHGLYAYGIKRGAKAVLMVTPSLEFFALTFALFKAGIVPILVDPGMGVKNLKQCFQEAEPDAFIGIPKAHLARRLFGWGKSSLTHLVTVGGSKLWGGASLEQLKQLGQGKGPFSMAQLDCDEMCAILFTSGSTGTPKGVVYSHRMFEAQISALKHDYQIAPGERDLATFPLFSLFGPALGMASIVPDMDASKPITANPDYIFAAIERYACTNMFVNPALIERLGQAGTSRDQKVKLGSLKRVISAGAPATIASIKRFSEMLTSDAPVLNSYGATESLPLSMITSHELFDTTEVTDNGGGICVGKPIDGVSMHIIDIDEAEIPTWSADLCLPREQIGEIVVQGPMVSASYYRRDKATAQAKIFDDQGQHYHRMGDLGYLDNQGRLWMCGRKAHRVDCRVDGQPRRYFSIPCERIYNTHSDIKRSALVGIKVKGEMQPLICLELEQGLSCSNAAALYTELRLLGEAHSQTQGITRFLIHPGFPVDIRHNAKIFREKLAVWAQSTYKE

SEQ ID NO: 362 - protein, 608 aa, Shewanella putrefaciens
MSTLLEKEVIPLVTETSFSTGTSQSAIASDANICRHLKQAAHDIPHHLAVAVQSAKGAAVANLRYSELDFLSLDRQSDVIAFALNAHGITRGMKAVLMVTPSLDFFALTFALFKAGIIPILVDPGMGIKNLKQCFAEAAPDAFIGIPKAHIARRLFGWGKGTIKILLNVDGGKTGFAAKLNCMATGAMSLSTLLQNTSAQSSAQKSPYPMVLLKPNEMAAILFTSGSTGTPKGVVYSHAMFEAQIQALKNDYGICHGERDLATFPLFSLFGPALGMASIVPEMDASKPITANPEFLFAAIEQYQCSNIFVNPALLERLGRAGEQKQHTLPSVKRVISAGAPATIASIARFSKMLSDGVPVLNSYGATESLPISMIASDALFATTEMTDNGAGICVGNAIDGVSIGIIGISEAVIPEWDDALLLKNGEIGEIIVQGPMVSQSYYQYDSQRDNQRDSATAMAKIWDPVANCVRHRMGDLGYLDDQGRLWMCGRKAHRIDATHKGKFAKRYYSIPCERIFNTHPNVKRSALVGVKVANEITPLICIELDTSLVCNKSQQLYQELTTLAEQFHQTQGIKRFLIHPDFPVDVRHNAKIFREKLAVWAQSQTKG

SEQ ID NO: 363 - protein, 545 aa, Geobacter uraniireducens
MNTDNFVNIAAHLPEMARRRPDAPAIIFPKKNRRLSFRELDAMSDRIAHGLVHHGIGRGVRTVLMVTPGPEFFALTFALFKVGAVPVLIDPGLGVKNLKKCLAEAGPRAFIGIPKAHVARLLFGWGKETLSTFITVGRRLFWEGTTLTSLIEQQEKLPFPLAPTERDDTAAILFTSGSTGPPKGAVYSHGNFAAQVDALRRVYGIEPGEIDLPTFPLFALFAPALGMTAVIPEMDFTRPGSVNPKKILSAIETYGVTTMFGSPALINRVGRFGEREGVKLPTLKRVISAGAPVPAAVMERFTRMLNAGVEVFTPYGATEALPVCSIGSSEILGETRRITDAGGGVCVGKPVEGVRLEVIEISDEPIPYWDDSLRAPIGKIGEIVVQGEQVTHGYFNRPEADLLSKIDDPAGGGFFHRMGDLGGKDEDGRIWFCGRKSHRVVTPEETLFTIPCEAVFNTHPAVFRTALVGIGEKGRQLPVLCVELEKGAKVDREKVRRELLAIADAHIHTRGITTILFHPAFPVDIRHNAKIFREKLAVWAAGRLS

SEQ ID NO: 364 - protein, 624 aa, Shewanella baltica
MSTLLETEVTPLLAAVVTPLETSLLTGTSASAMASDANICRHLKQAAHAIPHHLAVAVQSAQGASVANLRYSELDFLNLDRQSDAIAFALNAHGIERGMKAVLMVTPSLDFFALTFALFKAGVIPILVDPGMGIRNLKQCFAEAAPDAFIGISKAHIARRLFGWGKGSIKSLLNVDDGKTGLAAKLIRIATGAISLSTLLQNSSSRNASAQHTQAQHAEYPMVMLKSDEMAAILFTSGSTGTPKGVVYSHGMFEAQIKALKNDYGICHGERDLATFPLFSLFGPALGMASIVPEMDASKPITANPEFLFAAIEKYQCSNIFVNPALLERLGRAGEQKQHKLPSVQRVISAGAPATIASIARFSKMLSQGVPILNSYGATESLPISMIASDALFATTDITDNGGGICVGGAIDGVTIRIIGISEAVIPEWDEALVLNKGEIGEIVVQGPMVSQSYYLNNSQHDRQNESQGHSATAAAKMWDSATNSVRHRMGDLGYLDDQGRLWMCGRKAHRVDATRKGQLVKRYYSIPCERIFNTHPNVKRSALVGVKVANEIEPLICIELDQSLVCNKSQQLYQDLITIAEQFAQTQGIRRFLIHPDFPVDVRHNAKIFREKLAVWAQSQTKG

SEQ ID NO: 365 - protein, 585 aa, Shewanella sediminis
MSASLTASHSSKVNNSEPGANLCRHLNHAASDIPTELAVAVQHASGSIFSATSLNYKELTFAELDSLSDKLAHALNAYGIKRGMKAVLMVTPSLDFFTLTFALFKAGIIPILVDPGMGVKNLKQCFIESQPDAFIAIPKAHLARRLFSWGKDSVKHLVTVGGCGLWGGVSLDTLMEGVTSASSGSAYEMVWLDEDEMAAILFTSGSTGTPKGVVYSHKMFEAQITALKNDYGIAPGERDLATFPLFSLFGPALGMASIVPEMDASKPITANPDYLFAAIGKYQCSNMFVNPALIERLGQAGVTQTQIHKLSSIKRVISAGAPATIASIKHFSQMLNDGVEVLNSYGATESLPLSKMGSQALFATTEVTDSGGGICVGSPIEGVDIAIIDISEAPITQWNENLRLKPGEIGEIVVKGPMVSRSYYRRDSATEQAKIIDGSAIRHRMGDLGYLDDEGYLWMCGRKAHRVDTSQSVKGEPARYFSIPCERIFNTHPQVKRSALVGIEVKDQSGVPEVVPLLCLELNKSLSCSLGAGLYAELNAIAEKHTQTHGIKRFLIHPEFPVDIRHNAKIFREKLAVWAQKNHKE

SEQ ID NO: 366 - protein, 573 aa, Shewanella pealeana
MVSQLIQNNDGANLCRHLVSAAQTIPHSLAVAVQQANGKSVGGLHYQEMDFQTLNAKSDELASALVNHGLTPGMKAVLMVTPSIDFFCLTFALFKAGIIPILVDPGMGIKNLKQCFIEAKPDAFIGIPKAHIARRLFGWGKSSVKHLINVGGSGFAQALTGAASLESLLKANPSATTKPFKMQWLDDDAMAAILFTSGSTGTPKGVVYSHKIFEAQITALKHDYAIEPGERDLATFPLFSLFGPALGMASIVPDMDASKPITANPDFIFAAIDKYQCSNMFVNPALIERLGAAGEANQHKLSSIRRVISAGAPATISSIKRFSQMLNHGVEVLNSYGATESLPISKIGSQALFDTTAATDNGGGICVGKAVDGVDIAIIKIDEQPVEHWDDCLRLPVDSIGEIVVKGPMVSRSYYQRDSATQVAKIQDGDSIRHRMGDLGYLDNDGLLWMCGRKAHRVDADVLPATNNPAKRYYSIPCERIFNTHSDVKRSALVGVMVAGKVTPLICIELKQSVACSLSAVLYGELRAIAEQHLQTQGIERFLIHPDFPVDIRHNAKIFREKLAVWAQKQIKE

SEQ ID NO: 367 - protein, 564 aa, Desulfococcus oleovorans
MAPENHNPVINIAARMTQMARQHPYKKAVIAPQGRDRAGRVTYAHFTFAQLDADSSRLASGLEKAGIRRGTRTILMVRPSLDFFSLVFALFKAGIVPVVVDPGMGVKRMVSCFAETDPQAFIGIPLAHVVRKIYPKFFKTVETWVTVGNRWFWGGHTLDRIRASGTEDYKTAETLSDETAAILFTTGSTGPAKGVVYTHGNFDAQIQHIQDHFQIGSDETDLPTFPLFALFDPALGMTAVIPDMDPTKPAFVNPERILEGIANHGVTNMFASPALLNRVGGYCKKRNIVLPSLRRVVSAGAPVHPSNIEQFASALTDEAEVHTPYGASEAVPIISIGSREILTETKQMSEQGFGNCVGRPLEGIEVELITISDRPIEAWSDDLLVAPGDVGEFVVKADLVTRSYYNRPKDTAGAKIPDGDGFWHRMGDLAWMDNHGRFWFCGRKSHRVECADRTLFTVPCEAIFNNHPHVARSALVGVGPAGGQTPVICIEVIKEKRIRKKELASELLDLARTHELTKSIKTVLFHDNFPVDIRHNSKIFREKLAVWAAKKIKTKPRPSPKKRG

SEQ ID NO: 368 - protein, 628 aa, Shewanella baltica
MSTLLETEVTPLLAAVVTPLDTSLLTGTSASAMASDANICRHLKQAAHAIPHHLAVAVQSAQGASVANLCYSELDFLNLDRQSDAIAFALNAHGIERGMKAVLMVTPSLDFFALTFALFKAGIIPILVDPGMGINNLKQCFAEAAPDAFIGIPKAHIARRLFGWGKGSIKSLLNVDGGKTGLPARLIRIATGAISLSTLLQNSSSRNASAQHTQAQHAEYPMVMLKSDEMAAILFTSGSTGTPKGVVYSHGMFEAQIKALKNDYGICHGERDLATFPLFSLFGPALGMASIVPEMDASKPITANPEFLFAAIEKYQCSNIFVNPALLERLGRAGEQKQHKLPSVQRVISAGAPATIASIARFSKMLSQGVPILNSYGATESLPISMIASDALFATTDITDNGGGICVGGAIDGVTIRIIGISEAVIPEWDEALVLNNGEIGEIVVQGPMVSQSYYLNNSQHDRQNDSQHDSQGNSATAAAKMWDSATNSVRHRMGDLGYLDNQGRLWMCGRKAHRVDATRKGQLVKRYYSIPCERIFNTHPNVKRSALVGVKVANEIEPLICIELDQSLVCNKSQQLYQDLITIAEQFAQTQGIRRFLIHPDFPVDVRHNAKIFREKLAVWAQSQTKG

SEQ ID NO: 369 - protein, 564 aa, Chloroflexus aurantiacus
MRNEEQTAARVTFTVVAGANVARHLPLMARERPDQTAVVSGVGRDRAGKVIYRRQSFAGLHAASDRLAWGLTAYGLRKGMRVLLMVPAGVPLISLTFALMKAGCVPILIDPAMGRRNLAQCIAEVEPEAFIGVPRAHLLRLIFPRSCATIRYAVSVGPALPGAAALRELDIPMKTAFPLADMRSDDPAAIVFTSGSTGTPKGVLYTHGMFEAQIHTLRDLFGIAAGEVEMPAFPLFALFNVALGVTSAIPPIDPTRPAQCDPAAVVEFIRDLGVTSTFGSPAIWEKVTAYCLTHGIQLPSLRRVLMAGAPVPIHLHERLHRILSPTADSFTPYGATEALPVTSISGREVLAAHTEYPSPLAGTCIGYPVPGVEVAIIPITDEPIHAWQDTHRLPPGVIGEICVSGATVTHTYVGRPQATALAKISDGNRIWHRMGDLGYFDERGRLWFYGRKSQRVITAHGTLFTEPVERLFNQHPAVARSALVGIGKPGTQLPVVVVERRRDRAISTSQLIRELRQLATTTETTAIIQTFLIHPSFPVDIRHNAKIFREQLADWAARRLCIPV

SEQ ID NO: 370 - protein, 573 aa, Shewanella halifaxensis
MVSQLTQKNDGANLCRHLVSAAQTIPDSLAVAVQQSKGRAVSGLRYQEMDFQTLNAKSDELASALISHGLMPGMKAVLMVTPSIDFFCLTFALFKAGIIPILVDPGMGVKNLKQCFIEAKPDAFIGIPKAHIARRLFGWGKPTVKHLINVGGSAFAQALTGATSLESLLKANRSPTTVPFNMQWLDEDAMAAILFTSGSTGTPKGVVYSHKMFEAQITALKHDYAIKPGERDLATFPLFSLFGPALGMASIVPDMDASKPITANPDFIFAAIDKYQCSNMFVNPALIERLGQAGEAKQHKLASIKRVISAGAPATISSIKRFSQMLNQDVEVLNSYGATESLPISKIGSQALFDTTFVTDNGGGICVGKAIDGVEIAIIAIDEQPIIHWHDSLALPVDAIGEIVVKGPMVSRSYYQRESATQVAKIQDGASIRHRMGDLGYLDSDGLLWMCGRKAHRVDADALPATNNQAQRYYSIPCERIFNTHSDVKRSALVGVKVAGRVTPLVCIELKQSVACSLSGVLYSELRAIAEQHAQTQGIDRFFIHPDFPVDIRHNAKIFREQLAVWAQKQIKE

SEQ ID NO: 371 - protein, 574 aa, Shewanella woodyi
MTLSSQNPSHDFSLARSANLCRHLTLASQSFPEQLAVAVQTASCSFFSPKTLSYQELNFGELNRQSDKLAHGLNAYGIKRGMKAVLMVTPSLDFFTLTFALFKAGIIPILVDPGMGVKNLKQCFIESAPDAFIGIPKAHLARKLFGWGKESVRFLVTAGGRCLWGGVSIDTLLQGTPDTPYQMAALDEDEMVAILFTSGSTGTPKGVVYSHKMFEAQITALKHDYAIEPGERDLATFPLFSLFGPALGMASIVPEMDASKPITANPDYLFAAIEKYQCSNMFVNPALIERLGEAGVTDNQCHQLPSIKRVISAGAPATISSIKRFSRMLGEGVEVLNSYGATESLPLSKMASQALFATTDITDNGGGICVGEAIDGVDIAIIEINEHPINTWDETLRLAANDIGEIVVKGPMVSRSYYRRDSATEQAKIIDGDGVRHRMGDLGYLDSEGKLWMCGRKAHRVDASTQLPHQPQRYFSIPCERIFNTHPQVKRSALVGVNVSGDTVPLLCIELDTSLACSAGASLYAELNQIAQSHEQTKGISRFLVHPSFPVDIRHNAKIFREKLAVWAQSKHKE

SEQ ID NO: 372 - protein, 555 aa, Opitutus terrae
MAARQPTRMALKVPRGRTRAGDIDYLALTFAELATEVDAWATRIISAGVRPGDRTLVMVRQGLPLIASTFALFQVGAVPVVIDPGMGLRSFLGCVQRSRPRALVGIPLARVVSRLFPRAFRSVAARVPASNTLTARLSSPNSQPSTFNSQPPPLNSQPAQSAPTDLAAILFTSGSTGAPKGVCYEHGMFEAQVGIIRDTYAIEPGEIDLPLLPIFALFNPALGLTTIVPEIDPRRPAAMDPARIVQAIRQEGVTNSFGSPTLWKKIGQHCLTHRISLPGLRRVLCAGAPVPTELWSSSREWMPNGRLHSPYGATEVLPVSSVSSDEILVLDAHAAVSAARVAEGACVGRPVGGAQVKIIALTDTPIASLTDARELPPGRIGEIIVSGPTVTRAYADNPVATAAAKIAAVQPDGAPAVFHRMGDCGYLDPQGRLWFCGRKAERVETAHGPLFTEPCERVFRSHPRVHRCALIGFGERGHQRPALVVEVNTRNSHERRALAHELRELARAHSHTESINVFYFRPRFPVDVRHNAKIHRLALARWAATAHGYLSDPKR

SEQ ID NO: 373 - protein, 548 aa, Xylella fastidiosa
MKEPCNIAAALPRLARERPEQIAIRCPGRPGSGGMAAYDLTLSYRELDRRSDAIAAGFSAYGIGRGVRTVVMVRPSPEFFLLMFALFKVGAVPVLVDPGIDRSALKQCLSEAEPQAFIGVFLAQLARRLLRWAPSVTRVVSVGTRWAWCGTTLAHLERVGTGASAQLADTTADEVAAILFTSGSTGVPKGVVYRHRHFVGQIALLRETLGIVPGGVDLPTFPPFALFNPALGLTSIIPDMDPRCPARADPRKLHDAIARFGVSHLFGSPALLRVLAEYGKPLPTLRCVTSAGAPVPPQVVAQIRALLSDEAQFLTPYGATECLPVAVIESRELETTRAATERGAGTCVGHVIAPNLVRIIAIDDEGIAEWGGAREVGLGEIGEVTVVGPSATDVYYNRAAETCLAKIHERLADGSERIVHRMGDLGYFDAQRRLWFCGRKTHRVETVQGPLYTEQVEPVFNVIDGVRRTALVGIGALGAQRPVLCYEELPGVDVAALEQRLRATARAFMHTVGIVDVLRHPGFPVDIRHNAKIGRERLAVWAAQRLRR

SEQ ID NO: 374 - protein, 545 aa, Xylella fastidiosa
PCNIAAALPRLASERPEQIAIRCPGRPGSGGMAAYDLTLSYRELDRRSDAIAAGFSAYGIGRGVRTVVMVRPSLEFFLLMFALFKVGAVPVLVDPGIDRSALKQCLSEAEPQAFIGVFLAQLARCLLRWAPSVTRVVSVGTRWAWCGTTLAHLERVGTGASAQLADTTADEVAAILFTSGSTGVPKGVVYRHRHFVGQIALLRETLGIVPGGVDLPTFPPFALFNPALGLTSIIPDMDPRCPARADPRKLHDAIARFGVNHLFGSPALLRVLAEYGKPLPTLRCVTSAGAPVPPQVVAQIRALLSDEAQFLTPYGATECLPVAVIESRELETTRAATERGAGTCVGHVIASNLVRIIAIDDEGIAEWGGVREVGLGEIGEITVVGPSTTDAYYNRTAATRLAKIRERLADGSERIVHRMGDLGYFDAQRRLWFCGRKTHRVETVQGPLYTEQVEPVFNVIDGVRRTALVGIGALGAQRPVLCYEALPGVDVAALEQRLRATARAFMHTVGIVDVLRHPGFPVDIRHNAKIGRERLAVWAAQRLRC

SEQ ID NO: 375 - protein, 470 aa, Roseovarius nubinhibens
LLDQFAAAVERHPQRTAIIGGDGREITYRELQIRAQQFARKWRRKGIAHGDRVLLAMPVNADLYASLAGLWSLGATVVLPEPAMGLAGLRHAARTTRPKAFCAAGLFALLGFVVPELMRLRLLLPGGAPGDEPIALVQDADTALISFTSGTTGQAKAIPRSHAFLMAQHDAIAPVLESDLAERDLVAFPVFTLINLAAGRTTVLPNWKMNKLDRLSPEKLAGWIAQQQVTRLLIPPSLCETLARCEGIGPVHRVFTGGGPVFPDLIERLLGKPGLEVVCVYGSTEAEPIAHLEARDITDRDLRDMAAGKGLLVGRPVSQIKLRIRDDEVQVAGDHVNDGYLDPAHCEENKIKEGGTIWHRTGDAGRLDAQGRLWLWGRLGSDVKTPGGRMFPFAVEVAARQWSGVQQSALICLDERPVLCIEGDEGQLSEWRHLAQGFGVSDVLYLKKIPMDKRHRSKVDRAKLLQFLGS

SEQ ID NO: 376 - protein, 562 aa, Blastopirellula marina
MTTAASSTSKNVGLLLAQVAAERGDAVAIATPGRRDADGRRVYQTITFAQLEADSTRLAAGLAALGVTPGTRLALLVKPSIDFVSLVFALFKVGAVSVLIDPGMGRKNLLRCLDQVEPEGFVAISIVQAVRVLMGRRYGQAKMNVTVGRRWFWGGPTIDDLRKTDASHFQPVAAAADDPAAIIFTTGSTGPPKGVLFRHEGFYEQVQQIRDRYDIQPGEIDLPGFPLFGLFNSAMGVTSVIPEMDASRPAAVNPLNIIEPIHDWQITQSFASPAVWNKVGLYCEQHEIRLPSLKRVLSAGAPVPPHVLRRMKNAIHADGDIYTPYGATEALPIASIAASEVLDGTELASAQGAGTCVGRRFSGIQWRVIRITDADIATLDQCEAVDEGEIGELIVTGPVVTHRYFTSEAATQAAKIADGERIWHRMGDVGYLDAEDRFWFCGRKAHRVRTIDGDMFTIPCEAIANNHASIFRSALVGVGEPGDQFPVMIVEPWSDKYPQSREAIDALLEEVRQLCAAHPLTETIHDFLLHPAFPVDIRHNAKIFREKLAVWAEERLNEPSQD

SEQ ID NO: 377 - protein, 1122 aa, Psychromonas sp. CNPT3
MNKIREANLCRHLTLAAKKFPNDLAVAVQKKSVKGLTYQELTFATLHKKSDQIAYALTQQGLKPGDKVVLMVTPSLDFFSITFALFKAGMIPILVDPGMGIKNLKQCFIEACPSAFIGISKAHIARMLFGWGKNTLQHYFSVSPFSCFGIQSITALLKKYPMPAPFKMQTLDEHAMAAILFTSGSTGSPKGVVYSHSMFETQIDILRHDYHIEHGERDLATFPLFSLFGPALGMASIIPAMDASKPIKANPDYLFAAINKYKCTNLFANPALIERLGKAGCKQNIVLTSLKRVISAGAPATISSIQQFSRILNKETQIISSYGATESLPITKINSNKLVTTEKSTENGKGICVGSPIKNTTLAIIKISEDPIDHWHDNLCLAPYEIGEIVVQGKQVSRAYYQRQNATLLAKIPDKNDIRHRMGDLGYLDDEGMLWMCGRKAHRVESHYQGQSKCYFSIPCERIFNTHITIKRSALVSIRVGDSNEALLCVELQNPSLKNTQSLFNDLQALAQQHQITQGITRFLIHKSFPMDIRHNAKIYREKLALWAQLKYPLQNNKEHMTTAASSTSKNVGLLLAQVAAERGDAVAIATPGRRDADGRRVYQTITFAQLEADSTRLAAGLAALGVTPGTRLALLVKPSIDFVSLVFALFKVGAVSVLIDPGMGRKNLLRCLDQVEPEGFVAISIVQAVRVLMGRRYGQAKMNVTVGRRWFWGGPTIDDLRKTDASHFQPVAAAADDPAAIIFTTGSTGPPKGVLFRHEGFYEQVQQIRDRYDIQPGEIDLPGFPLFGLFNSAMGVTSVIPEMDASRPAAVNPLNIIEPIHDWQITQSFASPAVWNKVGLYCEQHEIRLPSLKRVLSAGAPVPPHVLRRMKNAIHADGDIYTPYGATEALPIASIAASEVLDGTELASAQGAGTCVGRRFSGIQWRVIRITDADIATLDQCEAVDEGEIGELIVTGPVVTHRYFTSEAATQAAKIADGERIWHRMGDVGYLDAEDRFWFCGRKAHRVRTIDGDMFTIPCEAIANNHASIFRSALVGVGEPGDQFPVMIVEPWSDKYPQSREAIDALLEEVRQLCAAHPLTETIHDFLLHPAFPVDIRHNAKIFREKLAVWAEERLNEPSQD

SEQ ID NO: 378 - protein, 608 aa, Photobacterium profundum
MDKGHETDASFDSDEASTLASLKANKANKANKANKANICRHLTRAAKETPDSLAVAVQIKSLFGKLRYEELTFEQLNTDSNAIAQALNDHGIKRGMKAVLMVTPSLDFFALTFALFKAGIVPILVDPGMGVKNLKQCFDEAKPDAFIGIPKAHIARCLFGWGKPSVRRLLTVGGNDVFANIFGGTTLKALLKRNTVIKPRSKMHQAVDYDIAKLKNDEMAAILFTSGSTGTPKGVVYTHAMFEAQISVLKNDYGIAHGERDLATFPLFSLFGPALGMTSIVPDMDASKPITANPDSLFAAIEQYQCTNMFVNPALIERLGQAGTQRHKPHTLPSIKRVISAGAPATISSISRFSKMLKDGVEVLNSYGATESLPLTMIGSDRLMQTTDITDNGGGICVGQAVDGVDIAIIAITDDPITIWDETLRLPVNQIGEIVVKGPMVSCAYYHRDHATVQAKITDGADTVRHRMGDLGYLDKNGQLWMCGRKAHRVEANRAAVASDKLPYFSIPCERIFNTHSSVKRTALVGIERNGETVPLLCVELNKGTTLTDDTARNTFFAELKTIGANHQQTVGIVDFLIHPDFPVDIRHNAKIFREKLAVWAQKEGKAS

SEQ ID NO: 379 - protein, 553 aa, Desulfuromonas acetoxidans
MMDCDLTENLAIHLTRRAEQQPYTAAVIFPEGRDRDGHVSYTHLTYQQLEQQSNRIACALSQYGVRCGDRTVLMVKPSLNFFSLTFALFKLGAIPVLIDPGMGVKNIKQCLEEVQPDVFIGIDKAHVARLLLGWGKNSLRLSITTGVSLRSTVPTLRTLVQRVAEAAPFTAHQPQNNETAAILFTSGSTGPPKGAIYTHTNFNAQIAALKQLYAIEPGEIDLCTFPLFALFAPALGMTAVIPDMDATRPAQVNPQRIFEAIDNFGVTNMFGSPALLRRVAQQGLLQHKQLPTLNRVISAGAPVPATVLEQFTSMMAPEAKIYTPYGATESLPVCSIDSTTLLGETRYLSDQGKGTCVGQAIIDVQIIAIDDEPIEHWTEDLTVADGVIGEICVRGPQVTSGYFNREQSNKRSKIFVEDGSFYHRMGDVGYRDDQGRIWFCGRKDHRVEHNGETLFSIPCEAVFNTHGDVFRTALVGLGSRPNQRAVLCVELNPGIGKERHDSIRQQLRDIQNNYPHTQAIDTILFHPRFPVDIRHNAKIFREKLAVWAAKEVS

SEQ ID NO: 380 - protein, 545 aa, Geobacter sp. FRC-32
MSRADFVNIAAHLPEMANSQPDTPAIIFPNKNCSLTFSELDRLSDRIAYGLETYGIGRGVRTILMVTPGPDLFTLTFALFKVGAVPVLVDPGLGVKNLKKCLADAEPQAFIGIPKAHMARKIFGWGEDTLRTFVTVGRRLFWEGITLAELVAGQGERAFPMAPTDRDDIAAILFTSGSTGSPKGAVYTHGNFAAQVEALRQVYGIEPGEIDLPTFPLFALFAPALGMTAVIPEMNFTRPGSVNPRKIISAIEKYHVTTMFGSPALINRVGRHGVKKGKRLPSLKRVISAGAPVPAAVMERFAAMLRPDAQIFTPYGATEALPVCSIGSDEILGETRAITEAGGGVCIGSPVKGIRLEVIEISDTPIDQWDDALRAPIGKIGEIVVQGEQVTRRYHNRPEADLLSKIKDPATGGFFHRMGDLGGRDEQGRIWFCGRKSHRVVTPEETLFTIPCEAVFNTHPSVFRTALVGVGEKGKQLPVLCVELEKGIRANKKKVRQELMNLAKAHIHTQGISTILFHPAFPVDIRHNAKIFREKLAVWAARSLK

SEQ ID NO: 381 - protein, 564 aa, Chloroflexus aggregans; identical to SEQ ID NO: 20

SEQ ID NO: 382 - protein, 544 aa, Geobacter lovleyi
MTMPTFANIAAHLPRMAQLQPDTTAIIFPKGNQSLTFQELDRLSDRICHGLIRSGITRGTRTVLMVTPSPEFFALTFALFKVGAIPVLIDPGLGIKNLKSCLAEVQPSAFIGIPKAQVARLLFGWAKDSLKTIITVGPRLFWGGITLDKLIQQSPDKPFEMAVTAADDQAAILFTSGSTGPPKGAIYSHGNFSAQVEALQQVYRIQPGEIDLPTFPLFALFAPALGMTAVIPEMDFTRPGSVDPQKIISAITSHKVTTMFGSPALINRVGRSGAEQGIKLPTLQRVISAGAPVPAVVMERFSQMLAEGVEIFTPYGATESLPVCSIGSREILGETRVITENGGGVCIGRPVDSIRVELIRISDEPITVWDDDLRVAPGQVGEIVVQGPQVTRGYFQRPEADLLSKISDPQGGFFHRMGDLGRQDETGRLWFCGRKTHRVESVHGPLFTIPVEAVFNTHPLVYRSALVGIGPKGSQQPVICIELEQGITTNQEQLRSELLNIAASHPHTREISTILFHPAFPVDIRHNAKIFREKLAVWAAEELA

SEQ ID NO: 383 - protein, 552 aa, Stenotrophomonas maltophilia
MNRPCNIAARLPELARERPDQIAIRCPGRRGAGNGMAAYDVTLDYRQLDARSDAMAAGLAGYGIGRGVRTVVMVRPSPEFFLLMFALFKLGAVPVLVDPGIDKRALKQCLDEAQPEAFIGIPLAHVARLVLRWAPSATRLVTVGRRLGWGGTTLAALERAGANGGPMLAATDGEDMAAILFTSGSTGVPKGVVYRHRHFVGQIQLLGSAFGMEAGGVDLPTFPPFALFDPALGLTSVIPDMDPTRPAQADPARLHDAIQRFGVTQLFGSPALMRVLARHGRPLPTVTRVTSAGAPVPPDVVATIRSLLPADAQFWTPYGATECLPVAVVEGRELERTRAATEAGAGTCVGSVVEPNEVRIIAIDDAPLPDWSQARVLFTGEVGEITVAGPTATDSYFNRPQATAAAKISETLADGSVRVVHRMGDVGYFDAQGRLWFCGRKTHRVETAHGPLYTEQVEPVFNTVPGVARTALVGVGPAGAQVPVLCVELQRGQSDSPALQEALRAHAAARAPEAGLQHFLVHPAFPVDIRHNAKIGREKLAVWASTELEKRA

SEQ ID NO: 384 - protein, 552 aa, Stenotrophomonas maltophilia
MNRPCNIAARLPELARERPDQIAIRCPGRRGAGNGMAAYDVTLDYRQLDARSDAMAAGLAGYGIGRGVRTVVMVRPSPEFFLLMFALFKLGAVPVLVDPGIDRRALKQCLDEAQPEAFIGIPLAHVARLVLRWAPSAARLVTVGRRLGWGGTTLAALERAGAKGGPMLAATDGEDMAAILFTSGSTGVPKGVVYRHRHFVGQIQLLGSAFGMEAGGVDLPTFPPFALFDPALGLTSVIPDMDPTRPAQADPVRLHDAIQRFGVTQLFGSPALMRVLAKHGRPLPTVTRVTSAGAPVPPDVVATIRSLLPADAQFWTPYGATECLPVAVVEGRELERTRAATEAGAGTCVGSVVAPNEVRIIAIDDAPLADWSQARVLAVGEVGEITVAGPTATDSYFNRPQATAAAKIRETLADGSTRVVHRMGDVGYFDAQGRLWFCGRKTQRVETARGPLYTEQVEPVFNTVAGVARTALVGVGAAGAQVPVLCVELLRGQSDSPALQEALRAHAAARTPEAGLQHFLVHPAFPVDIRHNAKIGREKLAVWASAELEKRA

SEQ ID NO: 385 - protein, 552 aa, Stenotrophomonas maltophilia; identical to SEQ ID NO: 6

SEQ ID NO: 386 - protein, 608 aa, Shewanella putrefaciens
MSTLLEKEVIPLMTETSLSTGTSQSAIASDANICRHLKQAAHDIPHHLAVAVQSAKGAAVANLRYSELDFISLDKQSDRIAFALNAHGITRGMKAVLMVTPSLDFFALTFALFKAGIIPILVDPGMGIKNLKQCFAEAAPDAFIGIPKAHIARRLFGWGKGTIKILLNVDGGKTSFAAKLNCMATGAMSLSTLLQNTSAQSSAQKSPYPMVLLKPNEMAAILFTSGSTGTPKGVVYSHAMFEAQIQALKNDYGICHGERDLATFPLFSLFGPALGMASIVPEMDASKPITANPEFLFAAIEQYQCSNIFVNPALLERLGRAGEQKQHTLPSVKRVISAGAPATIASIARFSKMLSDGVPVLNSYGATESLPISMIGSDALFATTEMTDNGAGICVGHAIDGVSIGIIGISEAVIPEWDDALLLKNGEIGEIIVQGPMVSQSYYQYDSQRDNQRDSATAMAKIWDPVANCVRHRMGDLGYLDDQGRLWMCGRKAHRVDATHKGKFAKRYYSIPCERIFNTHPNVKRSALVGVKVANEITPLICIELDTSLVCNKSQLLYQELTTLAEQFHQTQGIKRFLIHPDFPVDVRHNAKIFREKLAVWAQSQTKG

SEQ ID NO: 387 - protein, 546 aa, Geobacter bemidjiensis
MLESELVNIAAHLPEMAKRQPDTRAIIFPKQNRSLSFSELNTLSDRIARGLIANGICRGVRTVLMVTPSPEFFALTFALFKVGAVPVLIDPGLGIKNLKQCFAEAQPHAFIGIPKAHLARLIFGWGKETIRTWITVGPRLFWEGTTLNRIIDEHTDASPFVPAPTSSDDVAAILFTSGSTGVPKGAVYSHGNFAAQVQALKQVYGIEPGEIDLPTFPLFALFAPALGMTAVIPEMDFTRPGSVDPKKIIGAIHTYGVTTMFGSPALINRVGRYGVQHQVKLPTLRRAISAGAPVSAAVLERFTSLLNPGVQVFTPYGATEALPVCSIGSTEILETTRKITDAGGGVCVGRPVEGIRLEIVQISDDPICSWHESLRVPTGKIGEIVVQGEQVTRGYYNRPESDHLSKIADPETGSFFHRMGDLGGRDEEGRIWFCGRKSHRVETESGPLYTIPCEAVFNAHPAVFRTALVGVGAPGELKPVLCVELEKDVKVDPELVRAELLSYAQDHIHTKSIETILFHPAFPVDIRHNAKIFREKLAVWAAARLK

SEQ ID NO: 388 - protein, 629 aa, Shewanella baltica
MSTLLETEVTPLLAPLVTPLESSLLTGTSTSAMASDANICRHLKQAAHAIPHHLAVAVQSAQGASVANLRYSELDFLNLDRQSDAIAFALNAHGIERGMKAVLMVTPSLDFFALTFALFKAGIIPILVDPGMGINNLKQCFAEAAPDAFIGIPKAHIARRLFGWGKGSIKSLLNVDDGKIGLAARLMRIATGAISLSTLLQNDSSRQSSSQNASAKHASAQHAEYPMVMLKSDEMAAILFTSGSTGTPKGVVYSHGMFEAQIKALKNDYGICHGERDLATFPLFSLFGPALGMASIVPEMDASKPITANPEFLFAAIEKYQCSNIFVNPALLERLGRAGEQKQHKLPSVQRVISAGAPATIASIARFSKMLSQGVPILNSYGATESLPISMIASDALFATTDITDNGGGICVGGAIDGVTIRIIGISEDVIPEWDEALVLNKGEIGEIVVQGPMVSQSYYLNNSQHDSQNESQGHSATAAAKMWDSAANSVRHRMGDLGYLDDQGRLWMCGRKAHRVDATRKGQLVKRYYSIPCERIFNTHPNVKRSALVGVKVANEIEPLICIELDQSLVCNKSQQLYQDLITIAEQFAQTQGIRRFLIHPDFPVDVRHNAKIFREKLAVWAQSQTKG

SEQ ID NO: 389 - protein, 554 aa, Planctomyces maris
MSDSQRNIADRLKQSAQAWPFQKAVVFPAGQDKQGRYTYSSLTFQQLDQESDRLARGLIQLGVQPGTRMALMVRPSLEFIALTFALFKAGAVIILIDPGMGRKNIMRCLAEVEPEGFVAIPLAQLIRKLKHRSFPKAHLNVTVGKPVLTSGIDYEWLLGGEWEPFEIVQRSVTDPAAVIFTSGSTGPPKGVAYEHGMFWSQVDLLRDYYQIQPGEVDLPGFPLFALFNSAMGVTTVVPDMDPTKPAQVDPEKIIRQINDQGVTQAFGSPAMWNRIGRYCEQHQIQLPSLKRVLSAGAPVPVHVIQRMRQTFTNSETDINTPYGATESLPVASICGRDVLEKTSEQTQSGAGTCVGTPFPGVQVKIIQIHNEPIRSIEHAVELPVGEIGEIIVQGPMATREYFQRPEATQLAKIPDGDRFWHRMGDVGYRDAEGKLWFCGRKAHMLETSLGAMFTICCEAIFNQHPRVYRSALVGVGSKPNQKPVIIVEPEQGDYPENQAVRDQFTHELLTLGRANALTESIETVLFHRSLPVDIRHNVKIFREKLTPWAEKQVK

SEQ ID NO: 390 - protein, 549 aa, Lentisphaera araneosa
MSNANIACRLEEQVDQQAHKRAVIELHKRDENSGGGIYKHLTFLQLEELSSKYARAFAESGITKGSRVLLGVKPGADLCALTFALFKVGAVPVFIDPGMGPKHLLNCVEQAKAEAIVGLPAVFVFKLFNCKAFEGVKIKWSLGFCPIIGVKNLKSVSFQEKFYPACQMEQSDVAALLFTSGSTGPAKGVVYTCKIFNFQLDIIKEQYEVATTDMDMSVFPLFALFAVCMGMPTVIPDMDTSKPAAADPEKILQIMEEQDVSFSFGSPAFWKVMADYCEENNHKLNSVRCLVMAGCSVEPDLHRRYLNNILKEGAEIYVPYGATESLPLTSMKGSEVLSFSAERSEAGDGTCVGKPMSGEYDVKIIKISDDAVEEWSNDIVLKPGEVGEIVNSGPITTHEYYNNSKGTKKSKIYDGDKIWHRMGDLGYFDEQGYLWFCGRKNERVEIEQELLCTDKIENVLNLHKNVKRSALVPLNEKEAALIVEPNCEKLLESQDRQKVAIQEFVDLLKQKLPNLKIDKFLFKADFPVDVRHNAKIKRDLLREWAQKEI

SEQ ID NO: 391 - protein, 578 aa, Moritella sp. PE36
MTINATSEAINFCRHLSHAAFATPDSLAVAVQQSRKGQLVYDEINLASLDQQSDELAYALNAYGITRGMKAVLMVTPSIDFFVLTFALFKAGIVPILVDPGMGIRNLKQCFSESAPDAFIGIPKAHIARKLFGWGKDSVRFSLTVGGCEILSRLTGQMSLLRLLTDYRANLTVNKQQDEPIKPYPIALFDNSDLCAILFTSGSTGVPKGVVYSHQMFEGQIQALRDDYGINPGERDLSTFPLFSLFGPALGMASIIPDMDASKPITANPDFIFAAIEKYQCTNLFANPALIEILGQAGCKHDQPQILTSLKRVISAGAPATLSSISRFTRLLKTDVEVWNSYGATESLPLTKIGSKALLTMQEITDNGGGICVGQPIKDVEIAIIAICEDVIADWDDDLTLPTQQIGEIVVKGQVVSQRYYRRDVATQHAKIKDPTSTESQPVFRHRMGDLGYLDEQGQLWMCGRKAHSVATPSQRYFSIPCERIFNTHEQVKRTALVGIQYQGETIPLLCVELENDAVISTEQLFNELNAIGNKHQQTSTIKAFLIHSDFPVDIRHNAKIFREKLAVWAQKQAPYNR

SEQ ID NO: 392 - protein, 586 aa, Plesiocystis pacifica; identical to SEQ ID NO: 88

SEQ ID NO: 393 - protein, 623 aa, Opitutaceae bacterium
MTPAEKIGGRFCYPFILVPRFTVFDSPNIARHLDLMAASQPAHPALKIPRGRTRDGRIDYLTLTFAELHAEVSAWCRRLESRGVVRGDRVLVMVRQGLPLIAAAFALFRLGAVPVIIDPGMGRKNFLAAVAHSRPRVLLGIPAARIASHIFRRAFGSVEIRVPASSRATARLSGKSQISNPKPQILSPPPPAAEPIPTLDVGRSTLDVGRSREARPPPPPPSAFPCAQVAANETAAILFTSGSTGAPKGVVYTHGQFAAQVELVRSTYDIQPGEVDLPLLPVFALFNPALGTTTIVPEIDPSRPGAFDPARAVQAILQENVTYSFGSPTLWGKIARHCHATHTTLPGLRRVLCAGAPVPPWLWQALPPLLPDGTLHSPYGATEALPISSIEAGEVNNDTAAATLAGAGTCVGRVLPANQVKIIALTNAPLASLNANGLCELPPCTIGEIIVRGPTVTREYDRLPDATAHAKIPDADALWHRMGDCGYLDEQGRLWFCGRKAERVETIDGPLFTEQIEPVFNAHPKVRRTALIGLGPAGRQRPAIIVEPASTASDVLKDSAAARTLARELRALSLACPRPIPVKIFYFHPGFPVDVRHNAKIHRLTLTTWAQSGAIGYETDPKR

SEQ ID NO: 394 - protein, 529 aa, Shewanella benthica
MLEYQELNFFELNQRSDRLAHGLNAYGIRRGMKVVLMVTPSVDFFTLTFALFKAGVVPILVDPGMGVKNLKQCFIESEPDAFIGIPKAHLARKLFGWGKESVKHLVTVGGRNLFGGVTLAVIAALGSSEPYEMLWLDQDEMAAILFTSGSTGTPKGVVYSHKMFEAQISALRDDYGIKPGERDLATFPLFSLFGPALGMASIIPEMDASKPITANPDYLFAAIKKYQCTNMFVNPALIERLGQAGVQEGQGTEASHHKLPSIKRVISAGAPATISSIKHFSKMLSDGVEVLNSYGATESLPLSRMGSQALFNTTAITDDGGGICVGDAISGVDIAIIEITEQPISLWSESLRLEAGQIGEIVVKGPMVSRSYYRRDSATEQAKIQDGEMIRHRMGDLGYLDSEGKLWMCGRKAHRVDASGGQRYFSIPCERIFNTHPQVKRSALVGIEVNGDARRPEIVPLLCIELDKSLACSLGASLYAELNAIAEQHSQTLGIKRFLIHPEFPVDIRHNAKIFREKLAVWAQNKHKE

SEQ ID NO: 395 - protein, 556 aa, Xanthomonas oryzae
MTTLCNIAATLPQLARERPDQIAIRCPGARSANGFAVYDVTLSYAELDARSDAIAAGLALHGIGRGARAVVMVRPSPEFFLLMFALFKAGAVPVLVDPGIDKRALKQCLDEAQPQAFIGIPLAQLARRLLRWARSAGQIVTVGGRYGWGGVTLARVERDGAGAGSQLADTAPDDVAAILFTSGSTGVPKGVVYRHRHFVGQIDLLRNAFGMQPGGVDLPTFPPFALFDPALGLTSVIPDMDPTRPGSADPRKLHDAIARFGVTQLFGSPALMRVLADYGQPLPHVRLATSAGAPVPPDVVAKIRALLPVDAQFWTPYGATECLPVAAIEGRTLDATRAATEAGAGTCVGRVVAPNEVRIIAIDDAAIPDWSGVRVLATGEVGEITVAGPTTTDTYFNRDAATRIAKIRERRSDGSERIVHRMGDVGYFDAEGHLWFCGRKTQRVETVQGPMYTEQVEQIFNALPGIGRSALVGVGEMGRQRPVLCYEPDAYAWMSSPMEQEDVRQQLRSTAAAHPLTAGIADFLCHPGFPVDIRHNAKIGRETLAVWAAQQLHKSG

SEQ ID NO: 396 - protein, 285 aa, Gemmata obscuriglobus
MNTSLNVASHLVRMAAEHPTQVAVYAPRGRVRRDGPTEHRAITFRELNADSDAIAHGLASAGVARGTRTALMVPPSPDFFALTFALFKVGAVPVLIDPGMGVRNLGKCLAEAGPEAFIGVAKAHAARRVLGWAKGTVRATVNVSRWRFFCDTSLARVRKAGRGSGPYPVPDSQATEPAAVLFTSGSTGVAKGVVYVHGIFDAQVKLLKATYGIAPGEIDLCTFPLFALFGPALGMTCVIPDMDASRPARLDPHKAAAQIKQFGVTSLFGSPAVIRRLGELTVPSR

SEQ ID NO: 397 - protein, 255 aa, Gemmata obscuriglobus
MFTPYGATEALPVANIGSREILGETRHLTDQGKGVCVGRPVPGVEVRVIRISDQPVAEWDDSLLVPQGEVGEFVVRGPVVTQLYYNRPDATKLAKIRDPKTGEVLHRMGDVGYFDAQGRLWFCGRKSHRVVTPHGTLFTDMVEPIFNTVPGVRRTALVGVTRRGITYPVLWVELDRSSEPGSTLFDAVGGPSGPALDGLMSSIGQRSAAARRVVTYLLHPEFPMDVRHNSKIFREKLAVQADKLFGPNWSPGEQA

SEQ ID NO: 398 - protein, 322 aa, Arthrobacter chlorophenolicus
MDVTAPRTLTARTLAEAAKAIDATVVFASPAALRNVVATREDLDEAGLKALARVELLLSAGAPVPEPLLAEVQQLVPAASLHTPYGMTEALPVTDISLEQIREADAETAAGTLQGGGNGVCVGKPVHGARLAIIPLAADGTASGTTPVTDAGVTGEILVSAPHVKDSYDRLWLTQRESAGIPGWHRTGDVGHFDAAGGLWVEGRLAHVVSAPGAAVTPVGAEQAIERLDSVRLAAVTGVGPAGTQAVVAVVETVPPTRTAGPAEPALAASVRAAARTAGVEISAVLAVPAQPTDIRHNAKIDRTRLSRWATRVLAGGRPGKP

SEQ ID NO: 399 - protein, 550 aa, Xanthomonas campestris; identical to SEQ ID NO: 337

SEQ ID NO: 400 - protein, 548 aa, Xylella fastidiosa; identical to SEQ ID NO: 373

SEQ ID NO: 401 - protein, 548 aa, Xylella fastidiosa; identical to SEQ ID NO: 340

SEQ ID NO: 402 - protein, 553 aa, Desulfatibacillum alkenivorans
MEERIWHQHYDYNVQTSYRFPKVPVNGLLDIPANALPDKPAIDYYGSKISFWDLRIMSLKMANALADIGVQKGDRVGLHLPNIPQYIIAYYAALSLGAIVVNFNPLYTPDELTALVKQTGITTFVTFDMVIPNVKEVVKKAPIPRVIATSVFDFLEGSEVSTPESLQMKPEWRHFSTLINESKSEKKPKVDITPADPAMIQFTGGTTGIPKGAVLTHANMVTAAYSCFLWGSASQMYKTPEQRSVVCVLPFFHVYANIVCLNWAVLNCATMILVPRFEIDPLIDLLSKVENSVFLPAVPTMINAIVNHPKAAEIEIAKKLDMLNSGGGPIPVELIDQVNDLGIAYSEGWGMSETTSLGIANPVMGLKKPGSIGVPFPGMDVRLMDIDAGDKEVPQGEPGELTVKGPLVMKEYWDNPEKTAEALRDGWLYTGDIATMDEEGYFYIVDRKKDMIIAGGYNIYPRDIDEVLYQHPKIIDAVTIGVPDAYRGETVKAYVVIRPGEDLRAQDVIDFCKTKLAIYKVPKIIEFRDELPKSAVGKILRKVLRDEELAKSK

SEQ ID NO: 403 - protein, 357 aa, Micrococcus luteus
MSGFGYDVGLDAAGMPDLVERLASRRVLVTGASGLLGAGVARVLADAGNDVTTLQRRPSGVPGARDVRGSVTDPAAVEEALTGADTVVHVAAKVSVSGPEHEYEAVNVEGTRILLHAAQRHGVRRFVHVSSPSVAHAGDSIVGEGAGAASPEHARGPYARTKAAGERLALAADRDDFRVLVLRPHLMWGPGDLQLTDRIVQRARAGRMPVLGTGAPLVDTLYTANAVEAVVAAVSAADVHHGEALVVTNGEPRPVGELIRQIALAGGAAEPERRVPAGLARRAGALIERAWERDLFGLRSRGVGSDDGEPPLTEFLAEQLSTAHWFDQRRTREVLSWTPTVSIDEGLHRVAAYYRDR

SEQ ID NO: 404 - protein, 337 aa, Xanthomonas campestris
MMKILVTGGGGFLGQALCRGLVARGHEVVSFQRGDYPVLHTLGVGQIRGDLADPQAVRHALAGIDAVFHNAAKAGAWGSYDSYHQANVVGTQNVLDACRANGVPRLIYTSTPSVTHRATNPVEGLGADEVPYGEDLRAPYAATKAIAERAVLAANDAQLATVALRPRLIWGPGDNHLLPRLAARARAGRLRMVGDGSNLVDSTYIDNAAQAHFDAFAHLAPGAACAGKAYFISNGEPLPMRELLNRLLAAVDAPAVTRSLSFKTAYRIGAVCETLWPLLRLPGEVPLTRFLVEQLCTPHWYSMEPARRDFGYVPQISIEEGLQRLRSSSSRDISITR

SEQ ID NO: 405 - protein, 346 aa, Streptomyces ambofaciens
MKVLVTGGSGFLGLEICRRLSARGDVASSLHRRPSGALQQLGVHQHLGDLTDADAVSRAVAGCDAVIHNAALAGVSGPPRPYWATNVLGTRHVIEQCRAHGVRTLLYTSTASVVFRPGGLEGATESLPTAPRHLAAYPATKARAEALVLAAHGPELATVSLRPHIIWGPGDPHFAPVLARAVRAGRLLMPGDGANLIDTTHVRTAAHAHLLALDSLRRSPQTAGGRAYFIGQGDPRPLREITRHFLRAAGIDARWCAVPPRLATIGAAVGDTILRAARSTRTHALSRFLVAELLHPHYFDLTAARRDLDFAPPVGFDAGIAELSLSIPNDSEETPCRTPTTPSAPS

SEQ ID NO: 406 - protein, 336 aa, Xanthomonas campestris
MKILVTGGGGFLGQALCRGLVARGHEVVSFQRGDYPVLHTLGVGQIRGDLADPQAVRHALARIDAVFHNAAKAGAWGSYDSYHQANVVGTQNVLDACRANGVPRLIYTSTPSVTHRATNPVEGLGADDVPYGEDLRAPYAATKAIAERAVLAANDAQLATVALRPRLIWGPGDNHLLPRLAARARAGRLRMVGDGSNLVDSTYIDNAAQAHFDAFAHLAPGAACAGKAYFISNGEPLPMRELLNRLLAAVDAPAVTRSLSFKTAYRIGAVCETLWPLLRLPGEVPLTRFLVEQLCTPHWYSMEPARRDFGYVPQISIEEGLQRLRSSSSRDISITR

SEQ ID NO: 407 - protein, 332 aa, Xylella fastidiosa
MKILVTGGSGFLGEALCRGLLKRGYQVLSFQRSHYQALQALGVVQICGDLSDFHAVRHAVRGVDAVFHNAAKVGAWGSYTSYHQINVIGTQHVLDACRAENISKLVYTSSPSVIHRSNYPVEGLDADQVPYSNAVKVPYAATKAMAEQAVLAANSVDLTTVALRPRMIWGPGDPHLMPRLVARARAGRLRLIDDGRNLVDSTYIDNAAQAHFDAFEHLMPGAACAGKAYFISNGEPLQMRELINKLLAAANAPPVTQSLSFKTGYCIGAFCEMLWSLLPLLGEPLLTRFLVEQMSTPHWYSIEPAKRDFGYVPRVSIEEGLVRLLSETRVTG

SEQ ID NO: 408 - protein, 337 aa, Xanthomonas campestris; identical to SEQ ID NO: 404

SEQ ID NO: 409 - protein, 336 aa, Xanthomonas axonopodis
MKVLVTGGGGFLGQALCRGLRARGHEVVSFQRGDYPVLQRLGVGQIRGDLADPQAVRHAFAGIDAVFHNAAKAGAWGSYDSYHQANVVGTQNVIEACRANGVPRLIYTSTPSVTHRATNPVEGLGADEVPYGDDLRAAYAATKAIAERAVLAANDAQLATVALRPRLIWGPGDNHLLPRLAARARAGRLRMVGDGGNLVDSTYIDNAAQAHFDAFEHLAVGAACAGRAYFISNGEPLPMRELLNRLLAAVDAPAVTCSLSFNTAYRIGAVCETLWPLLRLPGEVPLTRFLVEQLCTPHWYSMEPARRDFGYVPRISIEEGLQRLRSSSSNDIAITR

SEQ ID NO: 410 - protein, 387 aa, Shewanella oneidensis
MTDNSSISLTPADLEHVPLQPTRLKQVGGDQACIKLSLDAREQTALDALAAKVSHAFVTGAGGFLGKAICQRLIAAGIKVTGFARGRYLELEALGVTMVQGDLVNPEQVKQAMQGCDIVFHVASKAGVWGDRDSYFCPNVKGAANVIAACKALKINKLVYTSTPSVTFAGEDESGINESTPYASRFLNYYAHSKAIAEKMMLDANQSSSTNAAYVLKTVALRPHLIWGPNDPHLVPRVLARGRLGKLKLVGREDKLVDTIYIDNAAYAHVLAALELCQATPKCQGKAYFISNDEPVTMAKMLNMILACDGLPPVTQRVPQMLAYAVGAVLETAYRLLNKQEEPIMTRFVAKQLSCSHYFDISAAKQDFGYSALVSIEEGMKRLKASL

SEQ ID NO: 411 - protein, 332 aa, Xylella fastidiosa; identical to SEQ ID NO: 146

SEQ ID NO: 412 - protein, 338 aa, Rhodopirellula baltica
MRVVVTGCSGFLGGEIVRQLLQRDCEVVGLSRRETADLVRAGMTHHRGDLLDTEYLARVIAGADVVIHTAAVAGVWGSWQHYFDNNVVASRNVLQACQELGVSQLIYTSSPSVTFDGNDQRDVDEAEPYPETWMCHYPHTKSIAEREILAADQPGGMRTVSLRPHLIWGPDDPHLIPRVLQRARSGRLRIIGDGSNVIDTVHVINAAAAHLDAMDAMQTRPDEAAGRAYFITQDEPVNCWDWIGKLCRVHGVDPPTKSISFAAAYRIGAVLETVYRLTGRTSEPPMTRFVASQLAKDHSFDITAAKERLGYRPRIDMDAGLQTLTDDPAVTNDRSTDR

SEQ ID NO: 413 - protein, 339 aa, Desulfotalea psychrophila
MGQSRVVTGKIERALVTGGNGFVGRAIVQMLLADGVQVRVVGRGLYPQLEAMGVECYRGDIGDQAFMVGAVEGMDVVFHVAALAGIWGEWDDYYKTNVLGTQSVIAACLGRVRALVYTSTPSVVFNRQSIANGDESLPYPEKFLCHYAKSKVMAEKSVLAVDPSRLACVALRPHLVWGPGDPHLIPRLVASRLQNRLKIVGKKDNIVDVSYVDNVAHAHLLAANNLLRAGTAAGRAYFISQGQPVNLWDWLNELFVRLDVPPLERSVPFSLAYALGAFFEGAYRVLGLQNDPPMTRFVAEQLAKSHYFSIENAQKDFGYAPIVSMEEGIICLVASFKKD

SEQ ID NO: 414 - protein, 371 aa, Photobacterium profundum
MSISPDLKSQLNRELLPDRELLACRELLPAEETALLPLSSNVKHAFVTGAGGFLGKAICRYLRIAGIQVTGFARGSYPDLEQMGVTMVKGDISTKSDLLQAMQGCDLVFHVASKAGVWGSKSDYYSPNVDGARNIIEACQELGIDKLVYTSTPSVTFAGSDEAGIDESAPYADSYLNFYAESKAIAEQMVLAANGKSVKTVALRPHLIWGPNDPHLVPRVIERARAGRLKLVGHEDKLVDTIYVDNAAYAHILAALRLTEPSSTCAGKAYFLSNDEPITMAAMLNKILSCVDLPKVTKRVPAGLAYQVGALLEWLYGVLNKKEEPIMTRFVARQLSTCHYFDISAAKRDLGYIPLVSIGDGMKRLKRTLNA

SEQ ID NO: 415 - protein, 402 aa, Xanthomonas oryzae
MDGALRNRSARVVDSEHRTHPPGIRRSVCWSLLALDSRLHGRTSTQDRQVGCGRLWCRPSEARCGAMKLLVTGGGGFLGQALCRGLRARGHEVVSFQRGNYPVLRSLGVGQIRGDLADPQAVRHALAGIDAVFHNAAKAGAWGSYDSYHQANVVGTQNVIEACRATGVPRLIYTSTPSVTHRATNPVEGLGADEVPYGDNLRAAYAATKAIAERAVLAANDAQLATVALRPRLIWGPGDNHLLPRLAARARAGRLRMVGDGSNLVDSTYIDNAAQAHFDAFEHLAVGAACAGKAYFISNGEPLPMRELLNRLLAAVDAPAVTRSLPFKTAYRIGAVCETLWPLLRLPGEVPLTRFLVEQLCTPHWYSMQPARRDFGYVPRISIEEGLQRLRSSSSNDIAITG

SEQ ID NO: 416 - protein, 400 aa, Colwellia psychrerythraea
MIEHSQNNATSHSKGKSNSDNSIDVTSRFNEAVQQPLSELAGQTNHVFVTGAGGFLGTAICRLLRLANIKVTGFARGHYPELSQMGVNMVQGDITDFALLKETMHSCDLVFHVAAKAGVWGSKDDYFKPNVQGAKNIIQACQELAITRLVYTSTPSVTFAGVDEAGIDESQPYADNFLNFYGESKALAEQLVLNASQDLKKSGNQSTTQATLQGDNQNSYQKNVLKTVALRPHLIWGPNDPHLVPRVLERARAGKLKLVGKEDKLVDTIFVDNAAYAHILAAVALNKANATCIGKAYFISNDQPITMAAMLNNILDCVDLPPVTKRVPSTVAYIVGATLEWFYKILNIKKEPVMTRFVARQLSTSHYFDISAAKKDLGYTPLISIEEGMKQLKLSLVVSS

SEQ ID NO: 417 - protein, 336 aa, Xanthomonas campestris
MKVLVTGGGGFLGQALCRGLRARGHEVVSFQRGDYPVLQRLGVGQIRGDLADPQAVRHAFAGIDAVFHNAAKAGAWGSYDSYHQANVVGTQNVIEACRANGVPRLIYTSTPSVTHRATNPVEGLGADEVPYGENLRAAYAATKAIAERAVLAANDAQLATVALRPRLIWGPGDNHLLPRLAARARAGRLRMVGDGSNLVDSTYIDNAAQAHFDAFEHLAVGAACAGKAYFISNGEPLPMRELLNRLLAAVDAPAVTRSLSFNTAYRIGAVCETLWPLLRLPGEVPLTRFLVEQLCTPHWYSMEPARRDFGYVPRISIEEGLQRLRSSSSNDIAITG

SEQ ID NO: 418 - protein, 336 aa, Xanthomonas oryzae
MKLLVTGGGGFLGQALCRGLRARGHEVVSFQRGNYPVLRSLGVGQIRGDLADPQAVRHALAGIDAVFHNAAKAGAWGSYDSYHQANVVGTQNVIEACRATGVPRLIYTSTPSVTHRATNPVEGLGADEVPYGDNLRAAYAATKAIAERAVLAANDAQLATVALRPRLIWGPGDNHLLPRLAARARAGRLRMVGDGSNLVDSTYIDNAAQAHFDAFEHLAVGAACAGKAYFISNGEPLPMRELLNRLLAAVDAPAVTRSLPFKTAYRIGAVCETLWPLLRLPGEVPLTRFLVEQLCTPHWYSMQPARRDFGYVPRISIEEGLQRLRSSSSNDIAITG

SEQ ID NO: 419 - protein, 376 aa, Shewanella denitrificans
MEGITVLVSKQTELEQQILNQTDIENSQLSCLTQGEQAVLRALKSQCTKVFVTGAGGFLGKAICKRLRAAGIEVVGFARSAYPELVRLGVDMYQGDICDYDKLLDAMKGCDLVFHVASKAGVWGSEDSYFLPNVNGTANVLRACKKHKIQKLVYTSTPSVTFQGQDENGIDESAPYASKFLNFYAQSKACAEKMVLAANGEKVKTVALRPHLIWGPGDPHLVPRVLARAKAGKLKLVGKEDKLVDTIFIDNAAYGHLLAGLDLCQAAKSAGKAYFLSNDEPITMAAMLNSILASADLPPVTKRVPAKLAFYVGYLLELVYGVLRVRTEPVMTRFIAKQLSSSHYFDISAAKNDLGYSPQVSMAEGMEKLKQSLLKS

SEQ ID NO: 420 - protein, 375 aa, Shewanella sp. MR-4
MTDNFSLLQTDATQTGRCDNLVQAGFEPREQVALNALATKISHAFVTGAGGFLGKAICQRLIAAGIKVTGFARCHYPELEALGVTMVQGDLVNPEQVKQAMQGCDIVFHVASKAGVWGDRDSYFCPNVKGAANVIAACKALKIGKLVYTSTPSVTFAGEDESGIDESTPYASRFLNYYAHSKAIAEKMMLDANQASTTTSAFALKTVALRPHLIWGPNDPHLVPRVLARGRLGKLKLVGREDKLVDTIYIDNAAYAHILAAVELCQVSPKCQGKAYFVSNDEPVTMAKMLNLILACDGLAPVTKRVPQTLAYVVGTVLETAYRLLKKQEEPIMTRFVAKQLSCSHYFDISAAKRDFGYHALVSIEEGMKRLKASL

SEQ ID NO: 421 - protein, 375 aa, Shewanella sp. MR-7
MTDNFSLLQTDATQTGRCDNLVQAGFEPREQVALNALAAKISHAFVTGAGGFLGKAICQRLIAVGIKVTGFARGHYPELEALGVTMVQGDLVNPEQVKQAMQGCDIVFHVASKAGVWGDRDSYFCPNVKGAANVIAACKALKIGKLVYTSTPSVTFAGEDESGIDESTPYASRFLNYYAHSKAIAEKMMLDANQASTTTSAFALKTVALRPHLIWGPNDPHLVPRVLDRGRLGKLKLVGREDKLVDTIYIDNAAYAHILAAVELCQVSPKCQGKAYFVSNDEPVTMAKMLNLILACDGLAPVTKRVPQTLAYVVGTVLETAYWLLKKQEEPIMTRFVAKQLSCSHYFDISAAKRDFGYHALVSIEEGMKRLKASL

SEQ ID NO: 422 - protein, 349 aa, Shewanella frigidimarina
MDLTDLHPLEQAALTQLSVSVNKVFVTGAGGFLGLAICQRLLAVGIQVVGFARGDYPRLVELGVDMRQGDISDYDNVKQAMQGCDLVFHVASKAGVWGSKQSYYSPNVDGVNNIINACKALNIQRLVYTSTPSVTFAGRDENGINESAPYAETYLNYYGESKAIAEQHVLAANSAQLHTTALRPHLIWGPNDPHLVPRVIERARAGRLKLVGHEDKLVDTIYVDNAAYAHVLAALDLVTNAKCAGKAYFLSNDQPITMADMLNRILASVDLPPVTKRVPAGVAYAAGVVLETVYGLLNKSQEPIMTRFVARQLSTSHYFDISAAKQDLGYQPLISLEQGMQKLKQSLSN

SEQ ID NO: 423 - protein, 394 aa, Shewanella sp. ANA-3
MHLITELNTKMTLTVTECDMTDNPVVLQADTTPTGRPDNLAQAGFDPREQAALYALAAKVSHAFVTGAGGFLGKAICLRLVAAGIKVTGFARGHYPELEALGVTMVQGDLAYPEQVKQAMQGCDIVFHVASKAGVWGDRDSYFCPNVKGAANVIAACKAFKISKLVYTSTPSVTFAGEDESGIDESTPYASRFLNYYAHSKAIAEKMMLDANQASITASAYALKTVALRPHLIWGPNDPHLVPRVLARGRLGKLKLVGREDKLVDTIYIDNAAYAHILAAVELCQVSPKCQGKAYFVSNDEPVTMAKMLNLILACDGLPPVTARVPQTLAYVAGAVLETAYRLLNKQEEPIMTRFVAKQLSCSHYFDISAAKRDFGYHALVSIEEGMKRLKASL

SEQ ID NO: 424 - protein, 331 aa, Pelobacter propionicus
MRALVTGGGGFLGGAIARMLRERGDQVRSFSRGEYPHLARLGVEQCRGDLTDREALLGAARGCDIVFHVAAKAGVWGSYDEFHRPNVIGTQNVLAACTSLGISRLVFTSSPSVVFDGRDVEGGDESLPYPSRYHAHYPRTKALAERMVLAANSPALATVSLRPHLIWGPGDNHLVPRILARARAGKLRRIGSCPCLVDTVYVDNAAQAHLLAADRLTPGAALCGRAYFISNGEPIPLWEMVNRILAAADLAPVERSIPPWLAYVAGSLCESLWGWLGRKNEPPMTRFVARELATAHWFDISAARRDLGYQPEVTLEEGFRRLREWLSRSRI

SEQ ID NO: 425 - protein, 351 aa, Shewanella amazonensis
MTQAYPLHPAQLEAAKRLKTHVSRVLVTGAGGFLGQALCRQLLSAGIEVVGIARSAYPALAAMGVEMHRGDIMDLKALSAAMNGCELVFHVASKAGVWGSRESYYGPNVTGAANVLQASQDLGIKAIVYTSTPSVTFDGKDESGIDESAPYAAHFLNHYGASKAEAEAMMLRASSPSLVITALRPHLIWGPKDPHLVPRVLERGRAGRLRLLGAEDKLVDTIYVDNAAHAHVLAAIALLEKPGECGGRAFFLSNGEPVTMASMLSKILACAELPGVTRRVPVWLAYGMGAVLEGMYTLLGKQDEPLMTRFVARQLSCSHYYDISAAREILDYEPLISLDEGMARLKASLQP

SEQ ID NO: 426 - protein, 357 aa, Psychromonas ingrahamii
MPVNKIPTFSHLNDQQQLVLRRLSIQVKKVFVTGAGGFLGKALCRFLRSADINVIGFARGDYPELEQMGVTMVKGDISDKKSLFDAMKGTDLVFHVASKAGVWGTMESYFSANIKGTENIIGVCQDLNIKRLVYTSTPSVTFAGKDENEIDESQPYADNFLNFYALSKAIAEAEILGSNSAALKTVALRPHLIWGPGDPHLVPRVLQRAKSGRLKLVGKTDKLVDTTYIDNAVYAHLLAAVNLSKANPNCAGKAYFVSNDQPILMAEMLNKILACQGLKPIDARIPAPLAYVIGATLEWVYLYLNIKKEPPITRFVARQLSTSHYFNISAAKNDIGYQPIVSIDQGMEKLKESLAES

SEQ ID NO: 427 - protein, 329 aa, Arthrobacter aurescens
MRVLVTGASGLLGGEVARQLVHQGHDVATFQRRPSGIDGAEDFRGSLNDDGALRSAIDRAEGIIHLAAKVSITGRAAEFDGVNIEGTRRLLQMARMAGVRDVVYVSSPSVAHSGSAIVGLGAEQADPRHAHGDYARTKAEAELLALAANGPDIRVAAVRPHIVWGPGDTQLVERVLARASHRRLPLLDAGAALIDTTYVDNAASAIVAALHRMEHVHGRAVVVSNGEPRPIGELLAGICDAGGVAPPSWSVPGGLARAAGAVVERFWTMAGRKEEPPMTRFLAEQLSTAHWFDQRVTRELLDWTPAVSLDEGLARLAEYYGSGTTGPLA

SEQ ID NO: 428 - protein, 375 aa, Shewanella sp. W3-18-1
MTNNPIKNPTLAQFDTLEQTALTQLALKATHAFVTGAGGFLGKAICLRLLAAGIKVTGFARGHYPELEALGVAMKQGDLVNKEQLQQAMQGCDIVFHVASKAGVWGDRDSYFCPNVKGAANVIAVCKALKINKLVYTSTPSVTFTGQDESGIDESTPYASTFLNYYAHSKAIAEKMMLDANQVSEVSVENTEATQMITPYALKTVALRPHLIWGPGDPHLVPRVLERGRLGKLKLVGREDKLVDTIYIDNAAYAHVLAALELCQPKPKCQGKAYFLSNDEPITMVKMLNLILACDGLPPVTRRVPRTVAYIAGAALESLYFLLKKKEEPLMTRFVARQLSCSHYFDISAAKRDLGYCALVSLDEGMARLRTSLLD

SEQ ID NO: 429 - protein, 373 aa, Shewanella loihica
MSITKHSNHTDNVNLLPEELEALTQLAGLSRHALVTGAGGFLGKAICQRLIAAGIAVTGFARGHYPELEAMGVNMVSGDICDLESVTNAMAGCDLVFHVASKAGVWGSKESYFAPNVQGCDNLLKAAAAHDIDSFVYTSTPSVTFAGEDESGIDERAPYASRFLNYYGESKAIAEQRVTAANSTSLSSANSPSEGKLNTVSLRPHLIWGPEDPHLVPRVIARARAGKLKLVGKVDKLVDTIYVGNAAYAHILAALTLKQNPQQCAGKCYFLSNDEPITMKVILNKILACAELPKVEKRVPASVAYLAGALLEGVYGLLGKCDEPIMTRFVARQLSTCHYFDISAAKRDLNYRPLVSIDEGMVQLSNWLKQEKV

SEQ ID NO: 430 - protein, 375 aa, Shewanella putrefaciens
MTNNPIKNPTLAQFDTLEQTALTQLALKATHAFVTGAGGFLGKAICLRLLAAGIKVTGFARGHYPELEALGVAMKQGDLVNKEQLQQAMQGCDIVFHVASKAGVWGDRDSYFCPNVKGAANVIAVCKALKINKLVYTSTPSVTFAGQDESGIDESTPYASTFLNYYAHSKAIAEKMMLDANQVSEVSVEHTEATQMITPYALKTVALRPHLIWGPGDPHLVPRVLERGRLGKLKLVGREDKLVDTIYIDNAAYAHVLAALELCQPKPKCQGKAYFLSNDEPITMVKMLNLILACDGLPPVTRRVPRTVAYIAGAALESLYFLLKKKEEPLMTRFVARQLSCSHYFDISAAKRDLGYCALVSIDEGMARLRTSLLG

SEQ ID NO: 431 - protein, 333 aa, Clavibacter michiganensis
MIVLVTGASGMLGRAVAERLAAAGHAVRAFQRQPSGLAASGTEPVPGSVVDLRGSVTDQASVARAVDGVDAVVHLAAKVSLAGDPDDFRAVNVEGTRGLLRAARAAGVTRFVHVSSPSVAHTGLSITGDGAGPADPVRARGDYARTKAEGELIALAADDPAMRVLAVRPHLVWGPGDTQLVARIVDRASRGRLPLLGHGAALIDTVYRDNAADAIVAALAAADTAHGRAYVVTNGEPRPVAELLAGMCRAAGVPAPRIRVPAALARAAGGAVERVWAVRPGSDEPPMTRFLAEQLSTAHWFDQRETRRALGWTPAVSLDEGFERLRLSYVAAR

SEQ ID NO: 432 - protein, 331 aa, Geobacter uraniireducens
MRALVTGGGGFLGGAIARLLVERGDTVLSFSRGEYPELARLGVEQIQGDLADREAVLRAATGCDIVFHVAAKAGIWGSHAEYHRANVTGTENVLAACRHHGIGRLVYTGSPSVVFDGRDVEGGDESLPYPTHFEAHYPKTKALAEQLVLAANSPSLATVSLRPHLIWGPGDNHLVPRIVAKARAGKLRRIGNSPCLVDTVYVDNAAHAHLLAADRLVFGGAVSGKSYFISNGEPIPLWEMVNRILAAAGLPPLTRCVPPKVAYAAGVVCEGLWSLLHLAGEPPMTRFVARELATAHWFNISAARRDLGYVPQISIDEGLKRLKAWLAGASL

SEQ ID NO: 433 - protein, 325 aa, Kineococcus radiotolerans
MKVLVTGASGMLGRETARALAARGEDVRLLQRRPAGLEGFEEVLGSVTDPAACARAVEGVQAVVHLAAKVSVTGPHPEYVATNVDGTANLLAAARAAGVSRFVMVSSPSVAHAGSALVGVGTTPADPATAHGSYAVTKARAELLALAADAPGFAVCAVRPHIVLGPGDTQLVQRIADRARAGRLPLLDDGTALIDTTYVDNAVDALLAALDRCEDEGVHGEAFVVTNGEPRTVSEVFARICRAAGVPAPTRRVPAAAAKVAGSVVERVWTRFGLPDEPPMTRFLAEQLSTAHWFDTTRTRERLHWSPRVPLDEGFDRLAGGFDAR

SEQ ID NO: 434 - protein, 365 aa, Shewanella sediminis
MSASNLSVSNRQMALEHYHIDEQLVLKKLSGQVKRAFVTGAGGFLGKAICQRLIAAGVEVTGFARGAYPELSAMGVNMIQGDISDNLAVIDAMKGCELVFHVASKAGVWGCKQSYFSPNVDGAANIINACKRLNIGYLVYTSTPSVTFAGADEAGIDETAPYADKYLNYYGESKAIAEQMVLDANGSKLKTVSLRPHLIWGPEDPHLVPRVIERARAGRLKLVGREDKLVDTIYVGNAAYAHILAALNLTEEQSSAAGRAYFLSNDEPITMAAMLNKILTCADLPEVDKRVPANLAYAVGVILETIYGLLGKTEEPLMTRFVARQLSTCHYFDISAAKRDLGYSPLVSIDQGMVKLREYLEANPV

SEQ ID NO: 435 - protein, 380 aa, Shewanella pealeana
MSLVNTSQPPTQTPKLDDFLPQEQAALLALKQDVTRAFVTGAGGFLGKAICERLLAAGIEVIGFARGDYPALSAMGVEMVKGDIADERALLGAMQGCDLVFHVASKAGVWGSKKSYFSPNVDGARHIIEACKACNIERLVYTSTPSVTFAGVDEVGNDESAPYAEQFLNYYGESKAIAEQMMLAANGAMLANGKLLGTTALRPHLIWGPNDPHLVPRVLERAEAGRLKLVGSEDKLVDTIYVGNAAYAHILAALTLSNGVSKGQVEDKNANQAACAGKAYYLSNDEPITMATMLNNILACKNLPPVTKRVPTNLAYAAGCILESIYALLGKKDEPIMTRFVARQLSTSHYFDISAAKRDLGYQALVSIDEGMEQLKASLQ

SEQ ID NO: 436 - protein, 330 aa, Desulfococcus oleovorans
MAKNILVTGGGGFLGSAIVRQLTARGDRVTTISRSLYPELSALGVKQIQADLSTPGPVEAACNGMDVVIHTAAKPGVWGKFDDYYRPNVLGTKNVVAACKKHQVPVLVHTSSPSVIFDGTDMEGINESYPYPSRFATHYTKTKAEAEQLVRAEAKAGAICAVVLRPHLIWGPGDPHLVPRVIARAKKLVKVGSRDNLVDTIYIDDAANAHVLAADRLAENPGLSGRVYFISQDQPIPMYEMLNGILAAAGLPPVTKTLPAGVVWCVGALLEAGYKTLDIQAEPPMTRFVAKELATAHWFDIRAAKKDLGYSPGITVEEGLERLAEWLRQQ

SEQ ID NO: 437 - protein, 329 aa, Desulfococcus oleovorans
MKAVVTGGGGFLAGHLIDKLVEAGHSVRTVELPGRNVQRLKDLDVEIVTGDLCDPSLAARACEGMDVVFNPAALAAPLGPWKRFWSINVELVDNVIAGCKKSGVRRLVHVSSPSAVFDGSDHFDADETLPFPKKFLNYYCATKAESEKRVLAANGTDLETVAIRPHAIWGPRDRTLFPRIIERAKSRRLVQVGDGTNIISTLYVENGADALILAATADRAPGNVYFVTDNDTVNLWGFLRRILNDLGLPPIRARIPYPLAYTLGATQEVLWTVLKLSGEPTITRYSAAELAKNHSYSIDRARTDLGYEPTVSREEGLQRFYEWVRNNLL

SEQ ID NO: 438 - protein, 331 aa, Chloroflexus aurantiacus
MIALVTGGNGFVGRYIVEQLLARGDHVRVIGRGAYPELQSLGAETYQADLTLPESAPVLARAMRGVTTVFHVAAKAGLWGSYDDFYRANVSATQRVVKAAIRAGVPKLVYTSTPSVVIGHEDIHGGDEHLPYPRRYLAPYPHTKAIAERYVLAQTDIATVSLRPHLIWGPRDPHILPRLLRRARRRMLFQIGDGTNLVDVCYVENAATAHIQAASALNERSPLRGRAYFIGQERPVNLWQFIGEILKAANCPPVRGRISASAATILATGLELLYTILRLPGEPPLTRLMVHELSHSHWFSHAAAERDFGYTPRISIEEGLERTFALTGSQP

SEQ ID NO: 439 - protein, 367 aa, Shewanella halifaxensis
MSLANKNQTPVLEDFLPEEQAALLALKQKVNRAFVTGAGGFLGKAICERLLAAGINVTGFARSEYPELSAMGVNMIKGDIANEQALLDAIQGCDVVFHVASKAGVWGSKQSYFSPNVDGAHHIINACKKCNIECIVYTSTPSVTFAGADEEGNDESAPYAKQFLNFYGESKAIAEQMMLAANGDKLSNGKYLGTTALRPHLIWGPNDPHLVPRVLERAAAGRLKLVGKEDKLVDTIYVGNAAYAHILAALKLSETSADRASCAGRAYYLSNDEPITMAAMLNKILECKDLPPVTKRVPSNVAYIAGCVLESVYGLLGKKDEPIMTRFVARQLSTSHYFDISAAKNDLGYSALVSIDEGMERLKASLQ

SEQ ID NO: 440 - protein, 337 aa, Clavibacter michiganensis
MIVLVTGASGMLGRAVAERLAAAGHAVRTFQRQPSGLASSGTDPVPGSVVDLRGSVTDPAAVLRAVAGVDAVVHLAAKVSLAGDPADFRAVNVEGTRGLLQAARAAGVTRFVHVSSPSVAHTGLSITGDGAGPADPVRARGDYARTKAEGELIALASDDPAMRVLAVRPHLVWGPGDTQLVARIVDRASRGRLPLLGHGAALIDTVYRDNAADAIVAALDAADTAHGRAYVVTNGEPRPVAELLAGMCRAAGVPAPRIRVPAALARAAGGAVERVWAVRPGSDEPPMTRFLAEQLSTAHWFDQRETRRALGWTPAVSLDEGFARLRLAYAAERPAAR

SEQ ID NO: 441 - protein, 361 aa, Shewanella woodyi
MSEMPDMNGLELHNFAIEEQVALSKLKAKAHHAFVTGAGGFLGKAICKRLLAAGIQVTGFARGDYPELSAMGVKMIKGDIADQTSVIEAMKGCDLVFHVASKAGVWGSKLSYFSPNVAGAAHIIQGCKQLGIANLVYTSTPSVTFAGEDEAGLDETAPYAETFLNYYGESKAVAEKMMIDANSEVLKTVSLRPHLIWGPEDPHLVPRVISRAKAGRLKLVGREDKLVDTIYVDNAAYAHILAAINLSEPDTKVAGKAYYLSNDEPITMADMLNKILACVDMPKVTQRVPASLAYGVGVILEAYYSLMNKQEEPVMTRFVARQLSTSHYFDISAAKTDFGYSAIVSIDQGMVKLREYLTEIE

SEQ ID NO: 442 - protein, 350 aa, Opitutus terrae
MCFVGSSSVLVTGGTGFLGRALVERLVAGGRSVTVLARHEQPALVARGVHFIRASLDEAPAVEAACAGVETVFHVAARVGVWGPYADFFRTNVLGTRALLAGCRQHGVRRLVFTSTPSVVYNGRDLAGADESLPLTTACPAAYPLTKAIAEREVLAANSEALRTIALRPHLIWGVGDPHLVPRLLARARAGRLRIVGSGRNRVDMVHVANAVDAHLLAEAALAGSQLAAPNSQPAPPAAAGKAFFITNGEPVVLWDWINGLLAALGERPVTRSISLGAAQTLGAVCEAAWRVLPLRGEPPMTRFVAAELAKDHWFDITAARRDLGYVPRISMAEGTAELIANLKGRAGYP

SEQ ID NO: 443 - protein, 328 aa, Brevibacterium linens
MKITVTGASGLLGSSVARALVADGHEVTTLQRRPSSVAGARDVIGSVTDPSRTAEALTGAEAVVHLAAKVSMMGDPSEFEAVNIGGTRTLVDAAQAAGVKRLVHISSPSVAHTGDSIIGAGAGPASPELARGEYARTKAAGELIALDADSQDFKVLVLRPHLMWGPGDTQLTERVIDRARAGRMPILGSGAPLVDALFVDNAVEAIVAAVDAVAATHGESLVVTNGQPRPIGELMSRIAIAGGAEVPKLRIPVGPALAAGSVVEKAWELGEHDDEPPLTRFLAEQLSTAHWFDQRRTQKVLGWTPRVSIEEGLRILAAHYSGAASDTE

SEQ ID NO: 444 - protein, 332 aa, Xylella fastidiosa; identical to SEQ ID NO: 145

SEQ ID NO: 445 - protein, 332 aa, Xylella fastidiosa
MKILVTGGSGFLGEALCRGLLKRGYQVVSFQRSHYQALQALGVVQICGDLSDFHAVRHAVRGVDAVFHNAAKVGAWGSYTSYHQINVIGTQHVLDACRAENINKLVYTSTPSVIHRSNYPVEGLDADQVPYSNAVKVPYVATKAMAEQAVLAANSVDLTTVALRPRMIWGPGDPHLMPRLVARARAGRLRLIGDGRNLVDSTYIDNAAQAHFDAFEHLMPGAACAGKAYFISNGEPLQMRELINKLLATTNAPPVTQSLSFKTGYCIGAFCEMLWSLLPLPGEPLLTRFLVEQMSTPHWYSIEPAKRDFGYVPRVSIEEGLVRLLSETRVTC

SEQ ID NO: 446 - protein, 328 aa, Blastopirellula marina
MRALVTGGGGFLGRYIVEQLLARGDQVRVLGRRDYPDLAAIGVNCLRGDVADAQIVSQACADQDVVFHTAAIAGIWGRWEDFYQANVVGTQNILAGCREHGVGKLVYTSSPSVTFDGTDQNGVDESVPYPTRWLAHYPRSKAIAEQQVLAANQPGKLLTCALRPHLIWGPRDQHLIPRLLQRAKSGKLRIVGDGKNRVDMIYVENAAVAHLQAAAALVAGGAVCGNAYFLSQGEPVVCWDWINELLELAKIPKLERKISYRAAFAIGRLLETAYKIARKYDTEPRMTRFLAAQLATNHYFDLSAARRDFGYQPQINMKEGMRRLAETL

SEQ ID NO: 447 - protein, 307 aa, Congregibacter litoralis
MERGDSVAVLQRRPCGLQVDEYLGDITDGALVSRAMAGADAVIHLAARVSVVGPWAEFQRTNVEGTRTVLEAAREAACSRFIQVSSPSVAHSGTSLVGAAAEPADPKGARGSYARSKALAEQMVLTAENMAVVAVRPHLVWGPGDTQLVARIVERARQGRLAVVGSGMALIDTTYTDNARDAIVAALDRAPDLSGRALVISNGEPRPVQELFDRMASAAKLSPARLKVPTVLARAGGRLVEGIWNLTGRQDDPPMTAFLAEQLSTAHWFDQRETRRLLDWTPAVSLDEGFQALTRWYAPEQRSSSEA

SEQ ID NO: 448 - protein, 360 aa, Psychromonas sp. CNPT3
MTEHNNVFFTKLPLTQQAVLSSLKAHVKCVFVTGAGGFLGKALCTHLRLHNIPVVGFARAYYPDLEALGVTMYQGDLNDEQALLKAMSGCDIVFHVASKAGVWGSKKSYFQSNVTGTENIINACKVHGINKLIYTSTPSVTFSGVDEEGIDESAPYAKTFLNYYALSKSIAEKQILDCDQTQLKTVALRPHLIWGPGDRHLVPRVLARAKAGRLKLLGKTDKLVDTTYIDNAVYAHLLSALELHKPQPKCAGKVYFISDDEPIFMADMLNKILACQHLPKVTERVPASLAYVFGAILECVYFCLNKQQEPMLTRFVAKQLSTSHYFNISNAKKDLGYHPLINISEGMQHLKKSLNKNPSK

SEQ ID NO: 449 - protein, 365 aa, Photobacterium profundum
MSISSHLKSPLNRELLPCCELLPAEETALLSLSSNVKHVFVTGAGGFLGKAICRYLRIAGIQVTGFARGSYPDLEQMGVTMVKGDISTKSDLLQAMQGCDLVFHVASKAGVWGSKSDYYRPNVDGARNIIEACQELSIDKLVYTSTPSVTFAGSDETGIDESAPYANSYLNFYAESKAIAEQMVLAANGKSVKTVALRPHLIWGPNDPHLVPRVIERARVGRLKLVGHEDKLVDTIYVDNAAYAHILAALRLTEPSSTCAGKAYFLSNDEPITMASMLNKILSCVDLPKVTKRVPAGLAYQVGALLEWLYGVLNKKEEPIMTRFVARQLSTCHYFDISAAKRDLGYTPLVSIDDGMKRLKHTLNA

SEQ ID NO: 450 - protein, 324 aa, Geobacter sp. FRC-32
MIVLVTGGGGFLGTAIARKLRQQGHQVRSYSRRHYSHLEQMDIQQFSGDLTDVNALKNAVSGCDLVYHVAAKAGIWGDYADYYQANVVGTENVIRACRDCGVSKLVYTSSPSVIFNGESMEGVDESQPYPEHYETAYPQTKALAEQKVIAANDDTLATVSLRPHLIWGPGDNHLTPRIIEGGRQGKLRRIGRQDHLVDCIYVDNAADAHLLAGEKIAIGSPISGKCYFISQDDPRYLWDIVNGILATQGIAPVCKTVPRQLAYILGGLCETIFRMLQLKKEPPMTRFVAKELSTAHWFSMDAAKKELGFQPKISIEQGLEQLKH

SEQ ID NO: 451 - protein, 331 aa, Chloroflexus aggregans
MKALVTGGGGFLGSAIVRLLMTRGDEVRSFSRSEYPELAQLGVEQVQGDLADQDCLMEAASGCDIIFHVAAQAGIWGDYAGYHRANVTGTENIIAACRENGIKHLVYTGSPSVIFDGRDVEGGDESLPYPVHFEANYPKTKALAEQMVLAANGPELATVSLRPHLIWGPGDNHLVPRIIARAKAGKLRRIGNRHCLVDTVYVDNAAQAHLLAADRLTHDSPIGGKSYFISNGQPIPLWEMVNAILDAAGLPPVTRTIPPQAAYAIGALCEQLWKFLPMKGEPPMTRFVAKELSTAHWFDISAARRDLGYQPEISIAEGLKRLKTWLSEREA

SEQ ID NO: 452 - protein, 329 aa, Chloroflexus aggregans; identical to SEQ ID NO: 22

SEQ ID NO: 453 - protein, 344 aa, Geobacter lovleyi
MGCGGTGMKALVTGGGGFLGGVIVRMLREQGDQVVSISRSSYPALTSLGVEQVQGDLADQAAVLKAAQSCDIIFHVAAKAGIWGSYNDFYQANVTGTGNVLEACRVHGITQLVYTSSPSVVFDGNDVEGGNESLPYPEHFEAFYPQTKALAEQLVLAANSPQLATVSLRPHLIWGPGDNHLVPRIIAKGKSGRLRRIGNRPCLVDTVYVDNAARAHLQAAERLAPGSVIAGKAYFISNGEPVQLWDMVNRILAAGGVAPVKGSISPKAAYAVGTMCEGIWKLLNLSGEPPMTRFVAKELATAHWFDISAARRDLGYQPQVTLDEGLVRLQKWLAETRPSPFPFL

SEQ ID NO: 454 - protein, 330 aa, Stenotrophomonas maltophilia
MKILVTGGGGFLGQALCRGLVERGHQVLAFNRSHYPELQAMGVGQIRGDLADAQAVLHAVAGVDAVFHNGAKAGAWGSYDSYHQANVVGTDNVIAACRAHDISRLVYTSTPSVTHRATHPVEGLGADDVPYGEDFQAPYAATKAIAEQRVLAANDATLATVALRPRLIWGPGDQQLVPRLAERARQGRLRLVGDGNNKVDTTYIDNAALAHFLALDALAPGAACAGRAYFISNGEPLPMRELVNKLLAAVGAPTVDKAISFKTAYRIGAVCERLWPLLRLRGEPPLTRFLAEQLCTPHWYSMEPARRDFGYVPQVSIEEGLRRLKASSAA

SEQ ID NO: 455 - protein, 330 aa, Stenotrophomonas maltophilia
MKILVTGGGGFLGQALCRGLVERGHQVLAFNRSHYPELQVMGVGQIRGDLADPQAVLHAVAGVDAVFHNGAKAGAWGSYDSYHQANVIGTDNVIAACRAHGIGRLVYTSTPSVTHRATHPVEGLGADEVPYGEDFQAPYAATKAIAEQRVLAANDASLATVALRPRLIWGPGDQQLVPRLAERARQGRLRLVGDGSNKVDTTYIDNAALAHFLAFEALAPGAACAGKAYFISNGEPLPMRELVNQLLAAVGAPRVDKAISFKTAYRIGAICERLWPLLRLRGEPPLTRFLAEQLCTPHWYSMEPARRDFGYVPQVSIEEGLRRLKASSAA

SEQ ID NO: 456 - protein, 330 aa, Stenotrophomonas maltophilia
MKILVTGGGGFLGQALCRGLVERGHQVLAFNRSHYPELQAMGVGQIRGDLADAQAVLHAVAGVDAVFHNGAKAGAWGSYDSYHQANVVGTDNVIAACRAHGISRLVYTSTPSVTHRATHPVEGLGADEVPYGEDFQAPYAATKAIAEQRVLAANDATLATVALRPRLIWGPGDQQLVPRLAERARQGRLRLVGDGNNKVDTTYIDNAALAHFLALDALAPGAACAGRAYFISNGEPLPMRELVNKLLAAVGAPTVDKAISFKTAYRIGAVCERLWPLLRLRGEPPLTRFLAEQLCTPHWYSMEPARRDFGYVPQVSIEEGLRRLKASSAA

SEQ ID NO: 457 - protein, 375 aa, Shewanella putrefaciens
MTNNPIKNPTLAQFDTLEQTALTQLALKATHAFVTGAGGFLGKAICLRLLAAGIKVTGFARGHYPELEALGVAMKQGDLVNKEQLQQAMQGCDIVFHVASKAGVWGDRDSYFCPNVKGAANVIAVCKALKINKLVYTSTPSVTFTGQDESGIDESTPYASTFLNYYAHSKAIAEKMMLDANQFGEVPLEHTDATQMITPYALKTVALRPHLIWGPGDPHLVPRVLERGRLGKLKLVGREDKLVDTIYIDNAAYAHVLAALELCQPKPKCQGKAYFLSNDEPITMVKMLNLILACDGLPPVTRRVPRTVAYIAGAALESLYFLLKKKEEPLMTRFVARQLSCSHYFDISAAKRDLGYCALVSLDEGMARLRTSLLD

SEQ ID NO: 458 - protein, 330 aa, Geobacter bemidjiensis
MKALVTGGGGFLGSAIVRQLLARGDQAVSFSRGEYPELALLGVEQRRGDLSDPEAVADAARGCDVVFHVAAKAGIWGEFEEYYRANVTGTENVIEACRRLGIERLVYTSSPSVVFDGSDVEGGDESLPYPAHFEAHYPHTKALAEQAVLAANAPELATVSLRPHLIWGPGDNHLVPRIVAKARSGALKRIGNRPCLVDTVYVENAAEAHLNAADRLKAGSAPAGKAYFISNGEPIPLWEMVNRILAAAGLPPITRQVSPGLAYGAGVVCETLWKMLRLSGEPPMTRFVAKELATAHWFDLSAARADLGYHPRISIDEGLRLLQDALRQGR

SEQ ID NO: 459 - protein, 333 aa, Planctomyces maris
MNVLVTGGGGFLGLYIVEQLVAAGETVRVLCRGEYQRLKELGVETVQGDIRDATTVERACEGIETVYHTAAVSGIWGHWDYFYSINTRGTLNVIASCQSQGVTRLVYTSSPSVVYDGSAHENATESLPYSEHFLCHYPHTKMLAERAVLQANGENGLATVALRPHLIWGPRDNHLIPRLIQRARSGRLRQVGEGTNLISMSYVENAAAAHLQAAARLFPDSPVGGQAYFINEPEPVLMWEWINQLLVEAGLQPVKKQISTKAAKRIGSVLEFVFRVLHLPGEPPMTRFLASQLSSSHYYDVSRARHDFGYEPCVSFEEAMRRMKPELQRLAAH

SEQ ID NO: 460 - protein, 331 aa, Moritella sp. PE36
MKHLITGGSGFLGRYIARQLLEQGQEVVLYNRSQPPSDLSECTWVQGDINETMKLTRAMEGCHNVFHTAAIAGVWGDEELFHKVNTLGTQSVLNACLSAKVSKLIYTSSPSVVFGIDAIENGNESLPYPDEYLTTYPKTKAEGEKIVLEANSEQLKTCSLRPHLIWGPEDQHLIPRLIQKAKSKRLKQVGNGENLVDLTYVENAAKAHLQVASELDKSSKPAGKAYFISDPKPVSLWPWIREILSLSECPPPNGSLSYAKAAKIGAILEWIYKTFKLKGEPPMTRFVAAQLAKAHYFDNSAAKKDFGYAPEIDNKEGLKRTLAWLKESGTV

SEQ ID NO: 461 - protein, 355 aa, Moritella sp. PE36
MTNFSSRPPVEQRALTALAATTKHAFVTGAGGFLGTSICLALIAAGIKVTGFARGHYPHLSKLGINMVQGDICDLSALTAAMKDCDLVFHVASKAGVWGSQADYYRPNVEGSANIIQASQSLAIERLVYTSTPSVTFTGEDEAGINESQPYAQSFLNYYAQSKALAEQMILAANSDRLKTVAIRPHLIWGPGDPHLVPRVIARAKLGRLKLVGKEDKLVDTIYIDNAAYAHILAALRLADPTPSCAGNSYFVSNDQPITMACMLNKILDCADLPPVTKRVPALLAYIVGTVLEKIYLWLGKTQEPMMTRFVARQLSTSHYFDISAAKADLGYQPLVSIDEGMQRLRVSLSRYIKV

SEQ ID NO: 462 - protein, 341 aa, Plesiocystis pacifica
MGGGPAAMKRALITGAGGFVGKSIARALLDRGVEVRGFCRGDYPFLREWGVELVRGDVQDRAALEAAVAGCDAVFHAAALVDIWGPYERFFATNVEGTRNVLAACRAAGARKLVYTSTPSVVHGGETVDGVDESAPYPDHFEAHYPATKAIAEREVLAANGAELVTAAIRPHLVWGPGDTSLMPRMIAKARTGRVKLIGEPQPIDTVYIDNAVAAHIAAAERLDPEHPERAPAGKAYFITQGEPMPGPQFLNDLLDINGLPPIEATISAAKARAAAAVIEGLWKLLRIRREPPITRFVVSQMSTAHWYDISAARRELGYEPAVSYAEGMQRLRSWVRDNPL

SEQ ID NO: 463 - protein, 332 aa, Plesiocystis pacifica
MARVLVTGGNGFVGRHLVDAFADRGDAVTALDLRGSSWRDEVRFASVDLRDAEATAAAVAGHDLVVHNASLVHTKQNRAEDVWAVNLGGTEHILAACQTHGVRKLVYVSSASVVYEGRDIRAGDETLPYARESQAPYADSKIAAEKRVLAASDAEVATCAIRPHVVFGPGDTRLLPAILDRARAGKMHYSVGPGTHLSDFTYIDNLSDAILAASDRLEPGAPLAGEALFVTNGEPMAFFDFVGRVLDRVGLPGPKRRVPFAVAYGAATVAETWDTWVKGGTLHAEDGMSRFAIRYLCTHHYFSIAKAKRLLDWAPKVSIAEGIERTATALEA

SEQ ID NO: 464 - protein, 364 aa, Shewanella benthica
MSVTHVSVDTQAAAIVLTEFHALEQAALQALKVKASHAFVTGAGGFLGKAICQRLLVAGIRVTGFARGDYPELTDMGVTMVRGDIADRAGVFDAMKGCDLVFHVASKAGIWGSKQSYFSPNVDGAANIISACQQLKISKLIYTSTPSVTFAGEDESGIDESAPYAANYLNHYGESKAVAEQMVLEANSQTLKTLALRPHLIWGPEDPHLVPRVIERAKAGRLKLVGKEDKLVDTIYVGNAAYAHILAAVNLCSQDASAAGKAYFISNDEPITMAAMLNKILACVDLPEVTKRVPAGLAYAVGVVLESVYGVLGKTDEPMMTRFVAKQLSTSHYFDISAAKADFGYSPIISIDQGMVKLREYLNS

SEQ ID NO: 465 - DNA, 50 bp, Artificial Sequence
  LB110
ccggtgaccaggatcttcatgcgcgtcggttcatccgttcattgtcgccg

SEQ ID NO: 466 - DNA, 50 bp, Artificial Sequence
  LB111
cggcgacaatgaacggatgaaccgacgcgcatgaagatcctggtcaccgg

SEQ ID NO: 467 - DNA, 23 bp, Artificial Sequence
  LB112
tgtcgcaccacgaccaggtcaag

SEQ ID NO: 468 - DNA, 33 bp, Artificial Sequence
  LB113
catctctagaactggaagatcggcgagtggatc

SEQ ID NO: 469 - DNA, 21 bp, Artificial Sequence
  LB114
gcgtaatgcagcatggcgctc

SEQ ID NO: 470 - DNA, 32 bp, Artificial Sequence
  LB115
tgacaagctttcagcctgcgcagcccttcttc

SEQ ID NO: 471 - DNA, 2066 bp, Artificial Sequence
  OleC deletion
ctagaactggaagatcggcgagtggatcatccgcacmttcaacgcsttctcgtccggtgcctcgtggctgggcgtggagcggaagatgccggccgacgtgcgccgcgcstacgtgtcgccgtacaacagctrsgccaaccgcatcagcaccatccgcttcatgcaggacatyccgctgtcgccggccgacaaggcstggtcgctgctggagcrtgccggcaaggcgctgccgtcgttcgccgaccgsccggccttcctcggctggggcctgcgcgacttcgtgttcgaccaycacttcctgaagggcttccaggccgcgctgccgcaggcccaggtrcatgcsttcgaggacgccggscaytacgtgctggaagacargcacgaagtgctrgtgccggaaatccgcgcgttcctggacaagaacccgatctgagaggtgtgccgaccaacggtcggcacccaccggaagaggaaatgggtaggtgccgaccgttggtcggcacacccgaagggttcatgaggttgccggccagcggccggcactatcactacgccgcgatcggcgcctgcggtgacgggctgttgccgttgtcgtccgggtggtcgtcgtcgttgcccgcttcgtcgcgccagcgccagtcggccagggtcaacggatccaggccataggcgatgcgcgccttgtcgcactgcgggctggccttgccgtactcccacgatgcatccacttcgcggcacacgctgggccggttggggtggatggtgcagcgtgaatacacgccgatctgcgcatccagcgccacgcagcgcaccggcttggagtgggtgccgcgcatgcacaggcgatgcggatcgagcacctcggtcagctggtgggggacgccgccgggcgtgacctcgtccgattccatccagtggaaggccacgcggtattgagtgcagcaggcgccgcaggtcatgcagggatgttgcatgggcaagccgcctcgggcggcagtcggaatcaggaacgagggtgcggattttccacgaagtgggccgccgcgcaagaaattccgtaagcggcgacaatgaacggatgaaccgacgcgcatgaagatcctggtcaccggtggtggtggtttccttggccaggcgctgtgccgcggtctggtcgaacgtggccaccaggtgctggcgttcaaccgcagccactacccggaactgcaggccatgggcgtgggccagatccgcggcgatctggccgatgcgcaggcggtgctgcacgcggtggccggcgtcgatgcggtattccacaacggtgcgaaggccggcgcctggggcagctatgacagctaccaccaggccaacgtggtcggcaccgacaacgtcatcgcggcctgtcgtgcacatgacatcagccgcttggtctacacctccacgcccagcgtgacccaccgcgccacccatccggtggaaggccttggtgccgacgacgtgccatacggcgaggacttccaggcgccgtatgcggcgaccaaggcgatcgccgaacagcgcgtgctggccgccaacgatgcaacgctggccacggtggcgctgcgcccgcgcctgatctggggcccgggcgaccagcagctggtgccccgcctggccgaacgcgcacggcaggggcgcctgcgcctggtcggcgatggcaacaacaaggtcgataccacctacatcgacaacgccgcgctcgcgcatttcctcgccttggatgcactggcaccgggtgcggcctgtgcgggcagggcgtacttcatttccaacggcgagccgctgccgatgcgcgagctggtcaacaagctgctggccgctgtgggtgcgccgacggtggacaaggcgatcagcttcaagaccgcttatcgcattggtgcggtctgcgaacggctgtggccgctgctgcgcctgcgcggcgagccgccgttgacccgcttcctggccgagcagctgtgcacgccgcactggtacagcatggagccggcacgccgggacttcggttacgtgccgcaggtcagcattgaagaagggctgcgcaggctgaa

SEQ ID NO: 472 - DNA, 50 bp, Artificial Sequence
  LB122
agccagtgacggcgatctatgcggcgatcttcatgcgcgcttctccagtt

SEQ ID NO: 473 - DNA, 50 bp, Artificial Sequence
  LB123
aactggagaagcgcgcatgaagatcgccgcatagatcgccgtcactggct

SEQ ID NO: 474 - DNA, 20 bp, Artificial Sequence
  LB124
aggacatggccgcgatcctg

SEQ ID NO: 475 - DNA, 31 bp, Artificial Sequence
  LB125
catctctagatgggcagcgccttcggcatgg

SEQ ID NO: 476 - DNA, 31 bp, Artificial Sequence
  LB127
tgacaagcttcggccaaccagggttcgtcgg

SEQ ID NO: 477 - DNA, 2026 bp, Artificial Sequence
  OleD deletion
agcttcggccaaccagggttcgtcggtgggcgtgagcaaggtgaaggacgcggcgggtttcgccggggcactggaactggcgctgcgctacgaccacaaggtgctggtcgaatcggcggtggtcggtcgcgagatcgagtgcgcggtgctgggcaacacgcttccgcaggccagcctgtgcggcgaggtggtggtgcacgacgagttctacgcctacgacaccaagtacatcaacgaggatggcgccgaggtggtggtgccagcggatatcgatgccgatacgcaggcgcgtatccagcagatcgcgctgcaggcctaccaggcgctggagtgcgcaggcatggcgcgcgtggatgtgttcctcaccgcagacggtgagatcgtcatcaacgaggtcaacacgctgccgggcttcacccgcatcagcatgtacccgaagctgtggggcgccagcggtgtggattacacgacgttgattacccgcctgatcgaactggcgctggagcgccatgcagccgatcgcggattgcacagcgctgtgtaggggcgctctgtgtctctgtagagtcgagccatgttcgactcatgaagagcagtcgagcagggctcgactctacaaatggcgtgccgaccaaggtgggcacctaccagacgatggcgtgccgaccaacggtcggcacccaccggaaagagcagtgccggccagcggccggcactaccctgcggtcttctagccgcgcttgcggaacatcgaaatcactgccagtaccaggaacacaacgaacaggatccaggcaatgttgctggcagcaccggcgatgccggagaagccgagcacggcggcgatgatggcgatgacgaaaaagatgacggcgtaatgcagcatggcgctcctcgcagatgtccgggccgttggatggcgtgggtccatactcccgatctggcggtgtgcagccagtgacggcgatctatgcggcgatcttcatgcgcgcttctccagttcggtgctggcccagacggcgagcttctcgcggccgatcttggcgttgtgacggatatcaacggggaacgccggatgcaccaggaagtgctgcaggccggcttctggcgcgcgggctgctgcgtgcgcacgcagcgcttcctgcagcgccgggctgtctgactgaccacgttgcagctccacgcacagcaccggcacctgcgcaccggccggaccaacaccgaccagcgccgtgcgcgcaaccccgggcacggtattgaacaccggctcgacctgctcggtgtacagcggcccatgcgcggtttccacccgatgggtcttgcgcccgcagaaccacagacgaccctgcgcatcgaagtagccgacgtcgcccatgcgatgcacgacgcgcacgctgccatcagccaaggtctcgctgatcttcgccgccgcggtggcctgcgggcggttgaagtagctgtcggtggcggtcggtccggccacggtgatctcgcccacctcgccggtgaacagcacacgcgcctgcgaccagtccggcagcggtgcgtcatcgatggcgatgatgcgcacctcgttcggctcgaccacgctgcccacgcaggtaccggcgccggcctcggtagcagcacgggtgcgctccagctcgcggccctccaccaccgccaccggcaagcattcggtggcgccatacggggtccagaactgcgcatcggcgggcagcagactgcggatggtagcgaccacatccggcggcaccggcgcaccggccgaggtcacccgggtcaccgttggcaggggccggccgtggcgggccaacacccgcatcagcgccggcgagccgaacagctgggtcaccccgaagcgctggatcgcgtcatgcagccgcgcagggtcggcctgcgccggccgggtcgggtccatgtccggaatcaccgaggtcaggcccagcgccgggtcgaacaaggcaaacggcgggaaggtcggcaggtccacgccgcccgcttccatgccgaaggcgctgcccat

SEQ ID NO: 478 - protein, 338 aa, Xylella fastidiosa; identical to SEQ ID NO: 162

SEQ ID NO: 479 - protein, 338 aa, Xylella fastidiosa Temecula1; identical to SEQ ID NO: 163

SEQ ID NO: 480 - protein, 349 aa, Shewanella baltica; identical to SEQ ID NO: 186

SEQ ID NO: 481 - protein, 349 aa, Shewanella baltica; identical to SEQ ID NO: 186

SEQ ID NO: 482 - protein, 349 aa, Shewanella putrefaciens; identical to SEQ ID NO: 185

SEQ ID NO: 483 - protein, 349 aa, Shewanella putrefaciens; identical to SEQ ID NO: 185

SEQ ID NO: 484 - protein, 399 aa, Shewanella baltica
MTINPIKSTTLAQFDAAEQTALAQLALKVQHAFVTGAGGFLGKAICLRLLAAGIKVTGFARGHYPELEALGVVMLQGDLVNKDQLQHAMQGCDIVFHVASKAGVWGDRDSYFCPNVKGAANVIAACKALKINKLVYTSTPSVTFAGQDESGIDESTPYATSFLNYYAHSKAIAEKMMLDANQVGDVSVESAAATQVTQATTANISGINSASTQVTIPNTSQVTAPYTLKTVALRPHLIWGPGDPHLVPRVLARGRLDKLKLVGREDKLVDTIYIDNAAYAHVLAALELCQAKPKCQGKAYFLSNDEPITMAKMLNLILACDALPPVTKRVPQSVAYVAGAVLETVYFLLKKQEEPMMTRFVARQLSCSHYFDISAAKRDLGYRALVSINEGMARLKASL

SEQ ID NO: 485 - protein, 399 aa, Shewanella baltica
MTINPIKSTTLAQFDAAEQTALAQLALKVQHAFVTGAGGFLGKAICLRLLAAGIKVTGFARGHYPELEALGVVMLQGDLVNKDQLQQAMQGCDIVFHVASKAGVWGDRDSYFCPNVKGAANVIAACKALKINKLVYTSTPSVTFAGQDESGIDESTPYATSFLNYYAHSKAIAEKMMLDANQVGDVSVESAAATQATQATTATISDNNLATTQVAIPNTSQVTSPYALKTVALRPHLIWGPGDPHLVPRVLARGRLDKLKLVGREDKLVDTIYIDNAAYAHVLAALELCQAKPKCQGKAYFLSNDEPITMAKMLNLILACDALPPVTNRVPQSVAYVAGAVLEIVYFLLKKQEEPMMTRFVARQLSCSHYFDISAAKRDLGYRALISINEGMARLKASL

SEQ ID NO: 486 - protein, 402 aa, Shewanella baltica
MTINPIKSTTLAQFDAAEQTALAQLALKVQHAFVTGAGGFLGKAICLRLLAAGIKVTGFARGHYPELEALGVVMLQGDLVNKDQLQQAMQGCDIVFHVASKAGVWGDRDSYFCPNVKGAANVIAACKALKINKLVYTSTPSVTFAGQDESGIDESTPYATSFLNYYAHSKAIAEKMMLDANQVGDVSVENTAVTQVTQATQATTETISDNNLAATQVAIPNTSQATAPYALKTVALRPHLIWGPGDPHLVPRVLARGRFDKLKLVGREDKLVDTIYIDNAAYAHVLAALELCQAKPKCQGKAYFLSNDEPITMAKMLNLILACDALPPVTKRVPQSVAYVAGAVLETVYFLLKKQEEPMMTRFVARQLSCSHYFDISAAKRDLGYRALISINEGMARLKASL

SEQ ID NO: 487 - protein, 324 aa, Desulfuromonas acetoxidans; identical to SEQ ID NO: 450

SEQ ID NO: 488 - DNA, 25 bp, Artificial Sequence
  LB402
atatactagtatgaatcgtccgtgc

SEQ ID NO: 489 - DNA, 38 bp, Artificial Sequence
  LB387
tatatctagacccgggagatctagatcgggtttttatc

SEQ ID NO: 490 - DNA, 33 bp, Artificial Sequence
  LB386
tatatctagacccgggttaccacacaacctcag

SEQ ID NO: 491 - DNA, 23 bp, Artificial Sequence
  LB388
tataggatccatgttgttcaaaa

SEQ ID NO: 492 - DNA, 1686 bp, Escherichia coli
atgaagaaggtttggcttaaccgttatcccgcggacgttccgacggagatcaaccctgaccgttatcaatctctggtagatatgtttgagcagtcggtcgcgcgctacgccgatcaacctgcgtttgtgaatatgggggaggtaatgaccttccgcaagctggaagaacgcagtcgcgcgtttgccgcttatttgcaacaagggttggggctgaagaaaggcgatcgcgttgcgttgatgatgcctaatttattgcaatatccggtggcgctgtttggcattttgcgtgccgggatgatcgtcgtaaacgttaacccgttgtataccccgcgtgagcttgagcatcagcttaacgatagcggcgcatcggcgattgttatcgtgtctaactttgctcacacactggaaaaagtggttgataaaaccgccgttcagcacgtaattctgacccgtatgggcgatcagctatctacggcaaaaggcacggtagtcaatttcgttgttaaatacatcaagcgtttggtgccgaaataccatctgccagatgccatttcatttcgtagcgcactgcataacggctaccggatgcagtacgtcaaacccgaactggtgccggaagatttagcttttctgcaatacaccggcggcaccactggtgtggcgaaaggcgcgatgctgactcaccgcaatatgctggcgaacctggaacaggttaacgcgacctatggtccgctgttgcatccgggcaaagagctggtggtgacggcgctgccgctgtatcacatttttgccctgaccattaactgcctgctgtttatcgaactgggtgggcagaacctgcttatcactaacccgcgcgatattccagggttggtaaaagagttagcgaaatatccgtttaccgctatcacgggcgttaacaccttgttcaatgcgttgctgaacaataaagagttccagcagctggatttctccagtctgcatctttccgcaggcggagggatgccagtgcagcaagtggtggcagagcgttgggtgaaactgacaggacagtatctgctggaaggctatggccttaccgagtgtgcgccgctggtcagcgttaacccatatgatattgattatcatagtggtagcatcggtttgccggtgccgtcgacggaagccaaactggtggatgatgatgataatgaagtaccaccgggtcaaccgggtgagctttgtgtcaaaggaccgcaggtgatgctgggttactggcagcgtccggatgctacagatgagatcatcaaaaatggctggttacacaccggcgacatcgcggtgatggatgaagaagggttcctgcgcattgtcgatcgtaaaaaagacatgattctggtttccggttttaacgtctatcccaacgagattgaagatgtcgtcatgcagcatcctggcgtacaggaagtcgcggctgttggcgtaccttccggctccagtggtgaagcggtgaaaatcttcgtagtgaaaaaagatccatcgcttaccgaagagtcactggtgaccttttgccgccgtcagctcacgggctacaaagtaccgaagctggtggagtttcgtgatgagttaccgaaatctaacgtcggaaaaattttgcgacgagaattacgtgacgaagcgcgcggcaaagtggacaataaagcctga

SEQ ID NO: 493 - DNA, 33 bp, Artificial Sequence
  pTrcF
tcgcgaggccggccccgccaacacccgctgacg

SEQ ID NO: 494 - DNA, 36 bp, Artificial Sequence
  pTrcR
gacgtcttaattaatcaggagagcgttcaccgacaa

SEQ ID NO: 495 - DNA, 109 bp, Escherichia coli
ggtaaagataaaaataaatagtgacgcgcttcgcaaccttttcgttgggtaattatcaagctggtatgatgagttaatattatgttaacggcatgtatatcatttgggg

SEQ ID NO: 496 - DNA, 127 bp, Artificial Sequence
  scar and T5 promoter
ggatgcatatggcggccgcataacttcgtatagcatacattatacgaagttatggatccagcttatcgatacaaatcataaaaaatttatttgctttgtgagcggataacaattataatagattcaa

The invention claimed is:

1. A genetically engineered cell comprising an exogenous nucleic acid encoding an OleA polypeptide-having at least 90% sequence identity to SEQ ID NO:2; wherein said polypeptide comprises one or more of the amino acid motifs set forth in SEQ ID NO: 64-69, 98-102, and 116-120, and wherein when cultured in medium containing a carbon source under conditions effective to express said OleA polypeptide, said cell produces an aliphatic ketone or an olefin.

2. The genetically engineered cell of claim 1, wherein the exogenous nucleic acid is selected from the group consisting of:
   (a) SEQ ID NO: 1, and
   (b) sequences having at least 90% sequence identity to SEQ ID NO:1.

3. The genetically engineered cell of claim 1, wherein the exogenous nucleic acid comprises one or more of (a) a promoter; (b) a regulatory sequence; (c) a selection marker; (d) a purification moiety; (e) a secretion sequence; and (f) a targeting sequence, operably linked to the polypeptide encoding sequence.

4. The genetically engineered cell of claim 1, wherein the cell is a yeast cell, a fungal cell, a bacterial cell, or an algae cell, selected from:
   (a) cells of the genus *Escherichia, Bacillus, Lactobacillus, Rhodococcus, Pseudomonas, Aspergillus, Trichoderma, Neurospora, Fusarium, Humicola, Rhizomucor, Kluyveromyces, Pichia, Mucor, Myceliophtora, Penicillium, Phanerochaete, Pleurotus, Trametes, Chrysosporium, Saccharomyces, Schizosaccharomyces, Stenotrophamonas, Kineococcus, Yarrowia, Streptomyces;*
   (b) an *Actinomycetes* cell;
   (c) an *Escherichia coli* cell;
   (d) a *Stenotrophomonas maltophilia* cell, a *Kineococcus radiotolerans* cell, a *Bacillus megaterium* cell, a *Saccharomyces cerevisiae* cell; and
   (e) an *Anaeromyxobacter* sp. Fw109-5, *Arthrobacter aurescens, Arthrobacter chlorophenolicus, Arthrobacter* sp. FB24, *Bdellovibrio bacteriovorus, Blastopirellula marina, Brevibacterium linens, Burkholderia ambifaria, Burkholderia cenocepacia, Burkholderia oklahomensis, Burkholderia pseudomallei, Burkholderia* sp. 383, *Candidatus Kuenenia stuttgartiensis, Chloroflexus aggregans, Chloroflexus aurantiacus, Clavibacter michiganensis* subsp. *michiganensis, Clavibacter michiganensis* subsp. *Sepedonicus, Clostridium botulinum* A, *Clostridium botulinum* A3, *Clostridium botulinum* B1, *Clostridium botulinum* Bf, *Clostridium botulinum* F, *Clostridium botulinum, Colwellia psychrerythraea, Congregibacter litoralis, Desulfatibacillum alkenivorans, Desulfococcus oleovorans, Desulfotalea psychrophila, Desulfuromonas acetoxidans, Flavobacteriales bacterium, Gemmata obscuriglobus, Geobacter bemidjiensis, Geobacter lovleyi, Geobacter* sp. FRC-32, *Geobacter uraniumreducens, Hahella chejuensis, Jannaschia* sp. CCS1, *Kineococcus radiotolerans, Lentisphaera araneosa, Maricaulis maris, Marinobacter algicola, Marinobacter aquaeolei, Micrococcus luteus, Microscilla marina, Moritella* sp. PE36, *Mycobacterium avium, Mycobacterium avium* subsp. *paratuberculosis, Mycobacterium marinum, Mycobacterium* sp. GP1, *Mycobacterium tuberculosis, Mycobacterium vanbaalenii, Neisseria gonorrhoeae, Nocardia farcinica, Opitutaceae bacterium, Opitutus terrae, Paenibacillus* sp. JDR-2, *Pelobacter propionicus, Photobacterium profundum, Photobacterium profundum, Photorhabdus luminescens* subsp. *laumondii, Planctomyces maris, Plesiocystis pacifica, Pseudoalteromonas atlantica, Psychromonas ingrahamii, Psychromonas* sp. CNPT3, *Ralstonia pickettii, Rhodococcus rhodochrous, Rhodococcus* sp., *Rhodopirellula baltica, Roseovarius nubinhibens, Shewanella amazonensis, Shewanella baltica, Shewanella benthica, Shewanella denitrificans, Shewanella frigidimarina, Shewanella halifaxensis, Shewanella loihica, Shewanella oneidensis, Shewanella pealeana, Shewanella putrefaciens, Shewanella sediminis, Shewanella* sp. ANA-3, *Shewanella* sp. MR-4, *Shewanella* sp. MR-7, *Shewanella* sp. W3-18-1, *Shewanella woodyi, Stenotrophomonas maltophilia, Streptomyces ambofaciens, Xanthomonas axonopodis, Xanthomonas campestris, Xanthomonas oryzae,* or *Xylella fastidiosa* cell.

5. The genetically engineered cell of claim 1, wherein the cell comprises a mutation or a deletion in a gene encoding an acyl-CoA dehydrogenase, or a mutation or a deletion in a gene encoding a thioesterase.

6. The genetically engineered cell of claims 1, wherein the cell additionally comprises an acyl-CoA synthase, or a thioesterase.

7. The genetically engineered cell of claims 1, wherein the cell produces a hydrocarbon intermediate.

8. The cell of claim 7, wherein the hydrocarbon intermediate is an aliphatic ketone.

9. A method for producing a hydrocarbon intermediate comprising culturing the genetically engineered cell of claim 1 with a substrate under conditions sufficient to produce the hydrocarbon intermediate.

10. The method of claim 9, wherein the substrate is a carbon source, a fatty acid, acyl-CoA, acyl-AMP, or acyl-ACP.

11. The method of claim 9, wherein the productivity of the cell is at least about 0.1 mg/L/$OD_{600}$, at least about 1 mg/L/$OD_{600}$, at least about 3 mg/L/$OD_{600}$, at least about 6 mg/L/$OD_{600}$, at least about 9 mg/L/$OD_{600}$, or at least about 12 mg/L/$OD_{600}$.

12. A hydrocarbon intermediate produced by the method of claim 9.

13. The hydrocarbon of claim 12, wherein the hydrocarbon intermediate has a carbon chain length of between about 10 to about 40 carbons, or about 19 to about 31 carbons.

14. The genetically engineered cell of claim 1, wherein the cell comprises reduced expression of a gene involved in fatty acid biosynthesis compared to a wild-type cell.

15. The genetically engineered cell of claim 1, wherein the polypeptide encoded by the exogenous nucleic acid induces the cell to produce an olefin.

16. The genetically engineered cell of claim 1, wherein the polypeptide encoded by the exogenous nucleic acid induces the cell to produce an aliphatic ketone.

17. A method of producing an olefin, comprising culturing the genetically engineered cell of claim 15 in a medium containing a carbon source under conditions effective to produce the olefin.

18. The method of claim 17, further comprising isolating said olefin from the cell or from the culture medium.

19. The method of claim 18, wherein the olefin productivity of the cell is at least about 3 mg/L/OD$_{600}$, at least about 5 mg/L/OD$_{600}$, at least about 8 mg/L/OD$_{600}$, at least about 15 mg/L/OD$_{600}$, at least about 20 mg/L/OD$_{600}$, or at least about 30 mg/L/OD$_{600}$.

20. A method of producing an aliphatic ketone, comprising culturing the cell of claim 16 in a medium containing a carbon source, under conditions effective to produce an aliphatic ketone.

21. The method of claim 20, further comprising isolating said aliphatic ketone from the cell or from the culture medium.

22. The method of claim 21, wherein the aliphatic ketone productivity of the cell is at least about 3 mg/L/OD$_{600}$, at least about 5 mg/L/OD$_{600}$, at least about 8 mg/L/OD$_{600}$, at least about 15 mg/L/OD$_{600}$, at least about 20 mg/L/OD$_{600}$, or at least about 30 mg/L/OD$_{600}$.

23. The genetically engineered cell of claim 1, wherein said OleA polypeptide comprises an amino acid sequence having at least 95% sequence identity to SEQ ID NO:2.

24. The genetically engineered cell of claim 1, wherein said OleA polypeptide comprises the amino acid sequence presented as SEQ ID NO:2.

25. The genetically engineered-cell of claim 1, further comprising an exogenous nucleic acid encoding an OleC polypeptide-having at least 90% sequence identity to SEQ ID NO: 6; wherein said OleC polypeptide comprises one or more of the amino acid motifs set forth in SEQ ID NO: 72-74, 103-108, and 121-126, and an exogenous nucleic acid encoding an OleD polypeptide-having at least 90% sequence identity to SEQ ID NO: 8; wherein said OleD polypeptide-comprises one or more of the amino acid motifs set forth in SEQ ID NO: 70-71, 109-115, and 127-133.

26. A genetically engineered cell comprising an exogenous nucleic acid encoding an OleA polypeptide-having at least 90% sequence identity to SEQ ID NO:2; wherein said polypeptide comprises one or more of the amino acid motifs set forth in SEQ ID NO: 64-69, 98-102, and 116-120, and wherein when cultured in medium containing a carbon source under conditions effective to express said OleA polypeptide, said cell produces an aliphatic ketone or an olefin, and wherein the genetically engineered cell is a bacterial cell or a yeast cell.

27. The genetically engineered cell of claim 26, wherein the cell is a bacterial cell.

28. The genetically engineered cell of claim 26, wherein the cell is a yeast cell.

* * * * *